United States Patent 11,098,302 (IDENTIFICATION OF POLYNUCLEOTIDES ASSOCIATED WITH A SAMPLE) - sequence listing, part 90

SEQ ID NO: 311682 - DNA, 740 bp, Homo sapiens
  misc_feature: GZ8MTXP02JR9SB.25.36.D03.1.454.CMB.2.raw
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
  modified_base (371)..(371): a, c, t, g, unknown or other
  misc_feature (371)..(371): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtcctccattctcttgttctgggancagctccgacgtacggaaattagttgtctacgtggtaccagcagcctacccgaacgaaacccggcccccaaagcctcctcatctaagtaggaatgatcgagccgccctgaacgggactacccgtgaaccgtntttccgtcgtcggtccttacggaacgttccgtcggggccctttcccgtcccggggtcccccttccccggtcggtcccctaacgttccgtaacggggttcgggggccccgtttccccgggggtacccgtaagggtaccgttggggtaacgggtccgttaaggttaaactttacgtttaccgttgggtacgtaccgtttaggggttttacgggacgttcggtaccccgttaggttcgtacggggttacgggttccgggggttacccggtacggggtttcggggttaccggggaccggggtaacgggtaaccgtaaacgggtcgttaccggaccccggttacgtacgggccgtaaccggacccgtaaccggg

SEQ ID NO: 311683 - DNA, 557 bp, Homo sapiens
  misc_feature: GZ8MTXP02JLIWZ.25.36.D03.1.454.CMB.2.raw
  modified_base (351)..(351): a, c, t, g, unknown or other
  misc_feature (351)..(351): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttatactggagctggatccgccagtccgccgggagggactggagtggattgggcgtatatatacgaatggattaaccacctacaacccctcctcaagagtcgagtcaccatatcagcggacacgtccagggatcgaggtgtcctgcatctgacttctgcgactgccgcgacacggccctatactacngtcgccagagattcgggactgacgacgtagttttacggagtaattattagttctttgtgtcttttgactagttggtggggaccgaaggggtacgacggtcgaccgtctcttcacgcctccgaccgaacgggcccacgtccggtccttcccccgtggccctaccctcctaccaacgcgaccaccgtcgtcggggccacgacgcccgg

SEQ ID NO: 311684 - DNA, 531 bp, Homo sapiens
  misc_feature: GZ8MTXP02FUQRS.25.36.D03.1.454.CMB.2.raw
  modified_base (243)..(243): a, c, t, g, unknown or other
  misc_feature (243)..(243): n is a, c, g, or t
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (444)..(444): a, c, t, g, unknown or other
  misc_feature (444)..(444): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggngtcttaataactatgtctcctggtcccaacaacaccaggcaacggcccccaaatcatcatttangatgcagtcatcggcctntggtatttctggtctcttctntacgctccaagtctggacctaactcggcctccctgacccatccgtcggggctccgagctggagcgagcttaacttattatgtctattactatacaganacaacaacagtctggtcgtcggtacggacggacgtaacgtacgtacgtacgtcgtcgacgaccgacgacgtccgcccgtccggtccg

SEQ ID NO: 311685 - DNA, 666 bp, Homo sapiens
  misc_feature: GZ8MTXP02FU4ZH.25.36.D03.1.454.CMB.2.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggacccccgggnagagggtctccatctcttgttcgtgggancagctccgacgtacggaaattagttgtctactggtaccagcacgcctacccgaagaaacccggcccccaaagccttaccctcacttactaagtaaggaatcggactccgaacggcccgggtacccccttacggaaccggggtacctacccgtaggaacccgtatttccgtcgttcgggcctacggtaagttccgtcgggtcccttcccgtccgggtcccttccgtcggcccaagttccgaggggttccgggcccttacccggggtaccggaggtactcgggacggtactaggtaaacttagtttacgtggtacgtcgttaggtttggacttcgaccgtagtcgtaggtcggtcggtaccggtggttggtccgggacgggaacggactaacggcgttcgaacccgttcgtaggaccacgcccgtaacgg

SEQ ID NO: 311686 - DNA, 564 bp, Homo sapiens
  misc_feature: GZ8MTXP02G4H58.25.36.D03.1.454.CMB.2.raw
  modified_base (198)..(198): a, c, t, g, unknown or other
  misc_feature (198)..(198): n is a, c, g, or t
  modified_base (299)..(299): a, c, t, g, unknown or other
  misc_feature (299)..(299): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctctcactcagggcacagggtcctgggcccagtctgccctgactcagcctgcctccgtgtctgggactcctggacngtcggtcaccatctcctgcactggaaccagccgtgacattggtgcttataactatgtctcctggtcccaacaacaccagcaacgccccaaatcatcattangatgtcagtcatccggcctcgtggtagtttcctggtcgtcttctctgctcagtctgcactcgcctccctgaccatcgcgggcctccgaggcctggacggacgaggcttacgttattattgctatttcaattacgagacgtacaacaacgtagtcgtcggttcgttcgggcgggtaacgggacctaaaggtttccggacccgttccgttaccggtaacgtacggaccccgtaaggtcccgtacccggtcccccgttcggttacccg

SEQ ID NO: 311687 - DNA, 535 bp, Homo sapiens
  misc_feature: GZ8MTXP02GMHC8.25.36.D03.1.454.CMB.2.raw
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
  modified_base (409)..(409): a, c, t, g, unknown or other
  misc_feature (409)..(409): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcgtcacatctctgcactggaaccngccgtgacattggtgcttataactatgtctcctgtccaacaacaccaggcaacggccccaaatcatcatttangatgtcagtcatcggccctgtggtatttcctggtcgtcttctctggctccaagtctggcaactcggcctccctgaccatcgtcggggcttcgaggctgagacgagctacttnttatgtctattcatacgagtacactaacaacagtcgtgttcggttcggacggtacggacctaaaggttccgaaccgtccgtacggtcgacgtacccgaacggtcctccggtcccccgtcggtcccg

SEQ ID NO: 311688 - DNA, 617 bp, Homo sapiens
  misc_feature: GZ8MTXP02HEA04.25.36.D03.1.454.CMB.2.raw
  modified_base (241)..(241): a, c, t, g, unknown or other
  misc_feature (241)..(241): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctctcactcagggcacagggtcctgggcccagtctgccctgactcagcctgcctcgtgtctgggactcctggacagtcgtcacatctcctgcactggaaccagccgtgactattgggtntacttatactatgtctctcgtaccaacaccaccagacaacgaccccaactcatctattatgatgtcagtctacgtccgtcctcgtggtacgttccgtcggtctcttctcgtcgtctcgtagtcgtcgactaccgtccgtccctcccgtacgacctacgtccgtcggggtcctcccgacggtccgtacggaacgggtaacggtacggtacttaacgtttaagtttacttcgtacttactttactaataacgacgaacgaaccaaccgtaacgtagttcgtaggttacggtcgggacggtaacgggtaaccgtaacggttccgtaccgtacgtacggtccgacgtacccgtaacggtccgtaccgtccccgtacgtcc

SEQ ID NO: 311689 - DNA, 554 bp, Homo sapiens
  misc_feature: GZ8MTXP02GYB2L.25.36.D03.1.454.CMB.2.raw
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (305)..(305): a, c, t, g, unknown or other
  misc_feature (305)..(305): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnagaggtctccatctcttgttctggancagctccgacgtacggaaatagttgtctactggtaccagcagcctcccaagaaaccggccccaagcctccncatctaataggaatgatcagccgcctgacggactacctgaccgtattctctggctcgaagtctggcctccgtcggccctcccgtggccagtcaggtcggccgtccggtcgaggactggaggctaggaattacttacgtgtgacgttaggtttcggatcgcctagtctaggtacggtcggtaccggacgggttggttcgggacgggacggaccgaagccgtcggaaccgtcgaggtacacgaccgaacgg

SEQ ID NO: 311690 - DNA, 640 bp, Homo sapiens
  misc_feature: GZ8MTXP02JUF5P.25.36.D03.1.454.CMB.2.raw
  modified_base (208)..(208): a, c, t, g, unknown or other
  misc_feature (208)..(208): n is a, c, g, or t
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggcggtctcatctcttgtcgnggancngctccgacgtacgtaattagttgtctacgtcgtaccagcacgcctacccgaacggaacccgaccccagtcctacctacactactaagtaagaatcgactcgacgccgacctacgacggtactaccgtacgaaccgtcttcgtcgtcggtactacggtaacgtccgtacggtccttcccgtccggtcccttacccgtcggacctacgtccgagggtccgggtcccgtaccggtacggaggtacgtacgtacggtacgtacgtaacgttacgttacgtagtagtacgtaggttaggtacgtacgtacgtacgtacgtacggtacggtcggtacggtacggtacgggtacgggtacggacggacgacgtaacgtacgtaccgtacgtacggtacgaccgaccgaccg

SEQ ID NO: 311691 - DNA, 544 bp, Homo sapiens
  misc_feature: GZ8MTXP02JCXDH.25.36.D03.1.454.CMB.2.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccgggnagagggtctccatctcttgttctgggancagctccgacgtcggaaatagttgctactggtaccagcagctcccaagaaaccggcccccaagcctcctcatctataggaatgatcagcggccctcgacgggactacctgaccgtattcctcgtggctacgagtctggctccgtcggccctccgtgcccatcgagtcggcctccggtcgaggactggaggctagaattattactgtgcgtaggtttgggatcgccagtctggaggttcggtccgacgggttgttcgggacggacgggacccaaggcgtcgacccgtccgtaggtcacggacccacgg

SEQ ID NO: 311692 - DNA, 712 bp, Homo sapiens
  misc_feature: GZ8MTXP02HJD0I.25.36.D03.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcactgtgcagggtcctgggcccagtctgtgctgactcagccacctcagtgtctgggacccccgggnaggacggtctcatcttcttgttcgngggancagcctccggaggtacggtaaattagtttgtactacgtcggtaccagcacgcctacccgaacggaaacccggaccccaacgcctacctacactactagtaaggaatgactcgacggcccggacctacgacggtactaccgtcgacctacttcctcgtcggctacggtaacgtcgtcggtccttccgtccggtcccgttcccgtcggacctacgtcgtacgggtcgggtcccgtccgggtaccggtagggtacgtaggacggtacgtagtaacttaacgttacgttgtacggtacggttagggtttagggtacgtcgtaccgtacggtcgttaggtacggttcgggtaccgggtacgggttcgggttacggggaccggggtaacgggaaccgtaacggtaccgtaccggtacccggttaccgtacgggtaaccgtaaccggacccgtaacgggtcccgtacccggtacccccggttcggtaccccg

SEQ ID NO: 311693 - DNA, 664 bp, Homo sapiens
  misc_feature: GZ8MTXP02I2NCZ.25.36.D03.1.454.CMB.2.raw
  modified_base (200)..(200): a, c, t, g, unknown or other
  misc_feature (200)..(200): n is a, c, g, or t
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccatgactcagcctcgctcagtgtccgggtctcctggacngtcagtcaccatctctgcactggaaccagaagtgatcttggtgcttatgacactgtctcctggcacctacgtttaccaaggaaacgcccccagacgtcattcctttatgtatgtcaggaacgccggcctcgacggggtccctgactcgtcttctcgtgggtaccaaatctgacaacgaccggccctccgtacgaccctatcccgtcgttcggggcccttccgaggtccgtaggaggtagtgggtaggtcgtttggtaattttatttaacgttcggtcctttaggtttaccgaaatttacgtcgtaaccggaagggtaaccctaaacgttaaaccggtttaacggtttttggggttacggtttccggggaccgggtaaccggtaacgggggtaaaccccgtaaaggggtttaccggtaacccggtaccggtttcgggggttaacccgaccgggtaaacccccggg

SEQ ID NO: 311694 - DNA, 515 bp, Homo sapiens
  misc_feature: GZ8MTXP02JV3ZR.25.36.D03.1.454.CMB.2.raw
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
tcagactgtacagtcacgaccggtgctcgatttagctgcgtcacgatctctcttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggtgcttatgacactgtctcctggcaccagtttacccaggaaacgcccccagagtcatccttatgatgtcaggaagcgcctcgacggggtccctgactcgcttctctcgggtaccaaatctggcaacgaccgcctccctgaccatctctgggctccaggctgagatgagctgattatattnctgtcatntgcaggactaactacgtagttttcggtgttcggcgtacgaggggaccctaaggttcgaccgtccgtgggtccacggtacccaacggg

SEQ ID NO: 311695 - DNA, 518 bp, Homo sapiens
  misc_feature: GZ8MTXP02J2NK6.25.36.D03.1.454.CMB.2.raw
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
  modified_base (514)..(514): a, c, t, g, unknown or other
  misc_feature (514)..(514): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggttttccttgttgttatttttccaggtgtccagagtgaggtgcagttggtggagtcgtgggggagcttggtccagcctgggagggtccgtgagagtctcctgtgcagcctctggattcatcttcagtgaccatacatggactgggccgccaggcctccgaggggagggctgggagtgggttgcccgtatagaaataagctaagagttacaccaacagaatacgccgcgtctagtagaaagcgagattcattatctacaagagatgattacaaaagactcactgtaatctagacaaatgaacagacctagaaaaccgngacacggcgtgactacgngtgctaggcagactacggtntacc

SEQ ID NO: 311696 - DNA, 641 bp, Homo sapiens
  misc_feature: GZ8MTXP02JDBPS.25.36.D03.1.454.CMB.2.raw
  modified_base (292)..(292): a, c, t, g, unknown or other
  misc_feature (292)..(292): n is a, c, g, or t
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtgtcccgggtctcctggacagtcagtcaccatctcctgcactggaaccagaagtgatcttggtgcttatgacactgtctcctggccacctagtttaaccccaaggaaaccncccccagacgtcacttccttatgatgtcaggaacgccggccctcgaccggggtccctgactcgtcttccgtcgtcgggtacctaaagtccgtacggacctaaccgaccggtcccttacccgtacgaccctactccgtccgtcggggtccctaccgacgggtcctagggagtacgttggaacggtcgtagttaagtttatttaagttgtcgttgttactaagttacgtgtaccgaggtacctaaacttacgttagttttcggggtcgttaccgggcgtacggtaacgggtaaccgtaacggttcggtacccggttaccggtacggtaccgtaacggtacccgtaaccggg

SEQ ID NO: 311697 - DNA, 513 bp, Homo sapiens
  misc_feature: GZ8MTXP02IYEX1.25.36.D03.1.454.CMB.2.raw
  modified_base (228)..(228): a, c, t, g, unknown or other
  misc_feature (228)..(228): n is a, c, g, or t
  modified_base (298)..(299): a, c, t, g, unknown or other
  misc_feature (298)..(299): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
tcagactgtacagtcacgaccggtgctcgatttagctgcgtcacgatctctcgttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccngccgtgacattggtgcttataactatgtctctgtccaacacaccaggcaaggccccaaatcatcatttannatgtcagtcatcggcctntggtatttcnggtctcttctctgctcagtctgcactcgcctccngaccntcgtcgggctcgagctgaggacgaggctacttattactgtctatttcattacaganacacaaagngtctggtcgtcggaggtacggacctaaggttcgacccgttcgacggtcgacgcccgaacggcctccggtccccgtacggtcc

SEQ ID NO: 311698 - DNA, 661 bp, Homo sapiens
  misc_feature: GZ8MTXP02H0FKW.25.36.D03.1.454.CMB.2.raw
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
  modified_base (321)..(321): a, c, t, g, unknown or other
  misc_feature (321)..(321): n is a, c, g, or t
tcagactgtacagtcacgaccggtgctcgatttagctgcgtcacgatctctcttggggggggtctcaggaggcagcgctctcgggacgtctccaccatggcctgggctctgctgttccctcaccctcctcactcagggcacagggtcctgggcccagtctgccctgactcagcctgcctccgtgtctggactcctggacagtcggtcaccatctcctgcactggaaccngccgtgactagttgggtntactttaataactatcgtcctcctcggtacccaacaaccacccaggaccaacggacccccaaatcatctattangatgtcagtcacgtccggacccttgtaggtacgtttccgtggtccgtcttcgtcgtcggcttaccgtaagttcgtcggacctaaccttccgggaccccttcccgtacgtacccgagttcccggtccggggcccttacccgagggtccgttaggaaacggggacgtacggtacctttaaacctttagttaacgtttcgttactaatttccaaattacgaagacgtaacaacccaaagtcgttccgtagggtcgttacggggcgggtaaacggacccgaaggttcgacccgttacgtcggaacgaccggaccgacggtccgtcccgtcccccgttaggtccc

SEQ ID NO: 311699 - DNA, 588 bp, Homo sapiens
  misc_feature: GZ8MTXP02HBQS8.25.36.D03.1.454.CMB.2.raw
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
  modified_base (460)..(460): a, c, t, g, unknown or other
  misc_feature (460)..(460): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggcagaggtctccatctcttgtctggagcagctccgacgtcggaaatagttgtctactggtaccagcagctccaagaaaccgccccaagcctcctcatctanagaatgatcagccggcctgacgggactaccgtgaccgtattcnctggctacgaatcctggcctccgtccggccctcccgtaggccctatccgaggttcgggcccgtccgggtaccgaggatggaaggctaggaaatttagttacgttgggtcgngttaggtttggggacttcgaccgtagtcgtggtacggtcgggtcccggaacgggtcggttaccggggacgggacgggaacccgaggccgtacggacccgttaccgtagggtccacggaccccgaacgg

SEQ ID NO: 311700 - DNA, 548 bp, Homo sapiens
  misc_feature: GZ8MTXP02GH7JF.25.36.D03.1.454.CMB.2.raw
  modified_base (209)..(209): a, c, t, g, unknown or other
  misc_feature (209)..(209): n is a, c, g, or t
  modified_base (299)..(299): a, c, t, g, unknown or other
  misc_feature (299)..(299): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagccaccctcagtgtctggggccccccgggnagagggtcgacatctcttgttctggaagtcgctccaacgtcggcagtaatagtgtaagctggtaccagcaactcccaggaccgcccccanactcctcatgtatgggaatgatcagccgcccctcgacggggtcccctgacccgattcctctcgccctccacgttctcggccaccctcacgccctcccgtgccagtcccgtgggcctccaatcctgaggatgaggccgtattattattgtgcagcggtgggatgacaggaagtacggttatgtacgttcggaagttcgggaaccaaggtcgtacccggtacgtacggtacaccgacccgaacggaccccc

SEQ ID NO: 311701 - DNA, 535 bp, Homo sapiens
  misc_feature: GZ8MTXP02IC0I4.25.36.D03.1.454.CMB.2.raw
  modified_base (246)..(246): a, c, t, g, unknown or other
  misc_feature (246)..(246): n is a, c, g, or t
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (458)..(458): a, c, t, g, unknown or other
  misc_feature (458)..(458): n is a, c, g, or t
  modified_base (477)..(477): a, c, t, g, unknown or other
  misc_feature (477)..(477): n is a, c, g, or t
tcagactgtacagtcacgaccggtgctcgatttagctgcgtcacgatctctcgttgggggggtctcaggaggcagcgctctcgggacgtctccaccatggcctgggctctgctgttcctcaccctcctcactcagggcacagggtcctgggcccagtctgccctgactcagcctgcctcgtgtctggactccgtggacagtcggtcaccatctcctgcactggaaccagccgtgactagtttggtnctttaataacttatgtctcctggtacccaacaacacccaggaccaacgcccccaaatcatctattangatgtcagtcancgcctgtgtgttcngtcgtcttcnctggctcagtctgactacgtcgcctccncgacntcgtcgggctcccgaggtctaggaggacgacgtctaactttatttactgtctatttacatacaagacgacaaccancgtagtggttacggtcggngggtacggactaaggttcgaccgttcgcgcgacgccgacggtctccgcccgtcggtac

SEQ ID NO: 311702 - DNA, 561 bp, Homo sapiens
  misc_feature: GZ8MTXP02FWYPR.25.36.D03.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (451)..(451): a, c, t, g, unknown or other
  misc_feature (451)..(451): n is a, c, g, or t
  modified_base (485)..(485): a, c, t, g, unknown or other
  misc_feature (485)..(485): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggaccccccggnagagggtctccatctcttgttctgggancagctccgacgtacggaaatagttgtctactggtaccagcagcctcccaagaaccggcccccaagcctcctcatctataggaatgatcagcgccctgacgggactacctgaccgtattccgtcgtgggctacggaagtcgtggcctcccgtcggccctcccgtcggccctatcgagtcgggccttccgggtccgaggactggacgtctaggaattnttaacgtgtagcgtaggtttggattcgccagtcnggtacgtcgggtaccgtcgggtgttacgggcggaacggacaagcgtcgaccgttctaggtacacggcccgtaacgg

SEQ ID NO: 311703 - DNA, 576 bp, Homo sapiens
  misc_feature: GZ8MTXP02IZGH2.25.36.D03.1.454.CMB.2.raw
  modified_base (207)..(207): a, c, t, g, unknown or other
  misc_feature (207)..(207): n is a, c, g, or t
  modified_base (357)..(357): a, c, t, g, unknown or other
  misc_feature (357)..(357): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggagcagctccgacgtcggaaatagttgtctactggtaccagcagcctcccaagaaaccggcccccaagcctcctcatctataggaatgatcagccggccctgacgggatacctgaccgtattccnctggctcgagtctgcctccgtccgccctcccgtggccctagtcgagtcggggccctccgggtccgtaggactggacggctaggaattattacctggtcgacgtaggtttggactgccgtagtctggtacggtcggtccgtacgggttgttccggggcggacgggacccgaaggtccgtacggtaacccggtcccgtaggcccgacggaccccgtaacgg

SEQ ID NO: 311704 - DNA, 523 bp, Homo sapiens
  misc_feature: GZ8MTXP02GXVQX.25.36.D03.1.454.CMB.2.raw
  modified_base (472)..(472): a, c, t, g, unknown or other
  misc_feature (472)..(472): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagagctgggctcagtgagtctctgcaggcttctggttacaccttagcagctatggcatcagcgtgggtgcgacacggcccctggacaagggcttggagtggagtggcagtggatcagtaccttaacatcggtatcacagactatgcacgagaacttccgagggacagacgtcactgaccacagacacactaccacgagacacacgcctaacagtacggacctaggaggacgccgtagagatcgacgacgacgacgacgtatacttacgngtcgacgagtagtaacgtattacgcgtacgttaccgtccggtacgtacccg

SEQ ID NO: 311705 - DNA, 539 bp, Homo sapiens
  misc_feature: GZ8MTXP02GZ0HQ.25.36.D03.1.454.CMB.2.raw
  modified_base (262)..(262): a, c, t, g, unknown or other
  misc_feature (262)..(262): n is a, c, g, or t
  modified_base (303)..(303): a, c, t, g, unknown or other
  misc_feature (303)..(303): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccgcgggagggactggagtggattgggcgtatatatacgaatggattaaccacctacaacccctcctcaagngtcgagtcaccatatcagcggacacgtccagggatcaggtnttcctgcatctgacttctgcgactgccgcggacacggccctatactactgtcgccagagattcggactgcgacgtatttttcggataattattattctttgtgttcttttgactatggtgggaccagggacgacggtcaccgtctcttcagcctccaccgtaacgggccctacgtccggtcctcccccgtggcccaccctcctaccagcgccaccgtcgtcggggcacgcgcccgg

SEQ ID NO: 311706 - DNA, 671 bp, Homo sapiens
  misc_feature: GZ8MTXP02JGT3K.25.36.D03.1.454.CMB.2.raw
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcggggacccccgggnaggagggtcctccatctcttgttctgggancagctccgacgtcggaaattagttgtctactggtaccagcagcctaccgaacgaaaccggcccccaagtcctcctacatctaataggaatgaatcagccgtccctagacgggactaccgtgaccgtattccgtgtcggtctacggtaaacgtccgtgggcccttcccgtccgggccccttccccgtggtaccccagttccgacggggtccggggtcccgtcccggggtccgagggtacgtgggacgggtcttaaggtaaaatttcgttacgtggttgacggttaggtttagggattcgccgtaagttcgtggttaacggtcgggttacccgggtacgggttcgggttccggggacggggtaaccgggacccgtaacggtccggtacggtacccggttaccgtacgggtacccacgggaccccgtaaccgggg

SEQ ID NO: 311707 - DNA, 603 bp, Homo sapiens
  misc_feature: GZ8MTXP02F8JS0.25.36.D03.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (340)..(340): a, c, t, g, unknown or other
  misc_feature (340)..(340): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtctccatctcttgttctggancagctcgacgtacgaatagttgtctactggtaccagcagctcccagaaaccgcccccaagcctcctacatctatagatgatcagccgccctgagggactaccgngaccgtattcctcgtgctcgaagtccgtgcctccgtccggcccttcccgtcggcctatcgtaggtcgggcccgtccgggtccgaggtagtggacggtcctagtaacttacttacgtggttgacgttggggtttacggattcggaccgtagtccgttaggacggttcggggtcccggtacgggtttcggttacggggccgggtaacgggaccaacggtccgtacggacccgttcggtacgggtaccacggtaccccgaacgggg

SEQ ID NO: 311708 - DNA, 544 bp, Homo sapiens
  misc_feature: GZ8MTXP02ILVOE.25.36.D03.1.454.CMB.2.raw
  modified_base (187)..(187): a, c, t, g, unknown or other
  misc_feature (187)..(187): n is a, c, g, or t
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
  modified_base (299)..(299): a, c, t, g, unknown or other
  misc_feature (299)..(299): n is a, c, g, or t
  modified_base (392)..(392): a, c, t, g, unknown or other
  misc_feature (392)..(392): n is a, c, g, or t
  modified_base (471)..(471): a, c, t, g, unknown or other
  misc_feature (471)..(471): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggaccccggnagaggtctccatctcttgttctgggancagctccgacgtcggaaattagttgtctactggtaccagcagctcccagaaccgccccaagctccncatctataggaatgatcagccggcctcgagggactaccgtgaccgatttcctctgggctacgaagttcctgggcctccgtccggccctcccgnggccatcgagtcgggcctccggtcgaggatggaggctagaattattacgtgtcgcgtagtttgggattcgcctagtcgngtacggtggtaccgaggttggtcggcgggaacggaccaaggcgtcggaccgtcgtaggtccaacgcccgaagg

SEQ ID NO: 311709 - DNA, 645 bp, Homo sapiens
  misc_feature: GZ8MTXP02GCK0H.25.36.D03.1.454.CMB.2.raw
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggtgcttatgacactgtcctcctggccacctacgtttaaccccaaggaaaccgcccccagacgtcattcctttatgatgtacgaggaacgcggccctcgaccggggtccctgactcgcttctcgtcgggtaccaaagtcgtgaccaacgtaccgccctccctgaccctatccgtccgtgggccctccgaggtccgtaggaggtagttacggaggtacttaggttaatttagtttagttcggtacctttggtttaccagttaagtcgacgtaggtaccttaaacgttacgtttaggttttcggttcggttaccggaccgtaaccggtaacgggtaaccgtaaagggtttcccggtaaacccggttccggtacgggttacccaaccgggttaccccgtaaacccggg

SEQ ID NO: 311710 - DNA, 618 bp, Homo sapiens
  misc_feature: GZ8MTXP02HIGGB.25.36.D03.1.454.CMB.2.raw
  modified_base (286)..(286): a, c, t, g, unknown or other
  misc_feature (286)..(286): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctctcactcagggcacagggtcctgggcccagtctgccctgactcagcctcgctcagtgtccggtctcctggacagtcagtcaccatcctcctgcactggaaccagaagtgatcttggtgcttatgacactgtctcctggcacctacgtttacccaggaaacnccccagagtcatccttatgatgtcaggaagccggcctcgacgggtcctcgactcgcttctcgtggttaccagtctaggccaacgaccggcctccctcgacctatcctcgtcgggctacccgaggccgtggaacggtagtacgaggtacttaggtaatttagtttaagtttcgtcgttacgttactagttagtacgtacgtaacggtactaaacgttacgtttacggtttcgggtcggttacgggtacggtacggtacgggtaaccgttaacggttaccgtaacccggttccggtacgggtaccgaaccggtacccgtaccggtcccgtcccg

SEQ ID NO: 311711 - DNA, 528 bp, Homo sapiens
  misc_feature: GZ8MTXP02F29QV.25.36.D03.1.454.CMB.2.raw
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctgtccaacaacacccagcaacgccccaaatcatcattatgatgtcagtcatccggccctctggtagtttcctggtcgtcttctctggctccaagtctggccaactcggcctccctgacctatccgtcggggcctccgaggcctggaacggacgagtcttacttagttattcgctatttcaatacagacaacaccaagagtctggtgttcgggcggtacggaacctagttcgaccgtcctcggcacgaccacggcctcgccccgtgtcc

SEQ ID NO: 311712 - DNA, 659 bp, Homo sapiens
  misc_feature: GZ8MTXP02JZDI1.25.36.D03.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagctccgacgtcggaaatagtttgtctactggtaccagcagctcccagaaaccggcccccaagcctcctcatctataggatgatcagcggccctcgacgggactaccgtgaccgtattcctctggcctcggaacgttctcgggcctcccgtccggtcccctcccgtcggccctacgtccgagggtcgggtcccgttacccgggtccggagggtagtcggacgggtcctaggaaattagtttaccgtggttacgccgttagggttttggggactttcggacccttaggttccgtagggtacgggtttcgggtcccgggtacggggttcgggtttccggggaccggggtaacgggggtaccccgaaaggtccgtacggtacccggttacccggtaacggtccgaaccggaccccgtaaaccgggg

SEQ ID NO: 311713 - DNA, 694 bp, Homo sapiens
  misc_feature: GZ8MTXP02G2USG.25.36.D03.1.454.CMB.2.raw
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcgggacccccgggcaggagggtctccatctcttgttctgggagcagctccgacgtacgaaatagttgctactggtaccagcacgctcccgaagaaaccggccccaagcctcctcatctaatagaatgaatcagccggccctgacggtatacctgaccgtattccgtctgggcctacggaacgttcgtcggccttccgtcccgggtcccttcccgtacggccctaagtcgaggttcggggcccgtcccgggttaccgggaagggagtgggaacgggcttaaggtaaaatttagttaccgtgggttacgacgttaagggttttcgggaagttaccggccgtaaggttcgttaagggtaacgggtttccggggttcccgggtaacggggtttcggggttccgggggacgggggtaaacgggaacccgaaaagggtcccgttaacggtaaccccggttcccggtaaagggttcccgaaaccgggtccccgtaaaaccggggg

SEQ ID NO: 311714 - DNA, 485 bp, Homo sapiens
  misc_feature: GZ8MTXP02I3UNM.25.36.D03.1.454.CMB.2.raw
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
  modified_base (421)..(421): a, c, t, g, unknown or other
  misc_feature (421)..(421): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcggtcaccatctcctgcactggaaccagccgtgacattggntcttataactatgtctctgtccaacacaccagcaacggcccccaaatcatcatttatgatgtcagtcatcgccctntgattctgtcgcttctctgctccagtctgcactcgctcctgcatcncggctcagctgaggacgagcttacttattattcgtntacttcatacagtagacacganagtctaggtgtcgcggaggaccagtcgaccgtcaggtcacgaccacgctcgccccgtcgtaccc

SEQ ID NO: 311715 - DNA, 656 bp, Homo sapiens
  misc_feature: GZ8MTXP02H486D.25.36.D03.1.454.CMB.2.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (409)..(409): a, c, t, g, unknown or other
  misc_feature (409)..(409): n is a, c, g, or t
  modified_base (428)..(428): a, c, t, g, unknown or other
  misc_feature (428)..(428): n is a, c, g, or t
  modified_base (456)..(456): a, c, t, g, unknown or other
  misc_feature (456)..(456): n is a, c, g, or t
  modified_base (521)..(521): a, c, t, g, unknown or other
  misc_feature (521)..(521): n is a, c, g, or t
tcagactgtacagtcacgaccggtgctcgatttagctgcgtcacgatctctcttggggagctctgagagcggagcccagccccagaattcccaggtgttttcatttggtgatcagcactgaacacagaggactcaccatggagtttgggctgagcttgggttttccttgtttgttatttttccaggtgtccagagtgaggtncagttggnggagtcgtgggggagcttggtccagccgtgggacgggtcgtgagagtctcctgtgctagcctctggattcatcttcagtgacccatacagtcggacgtgggtcccgccgaagggcctacggaaggggaaggggctaggggaggtggggtgaccccgtaagttaaagaaactaaggctaaaggtacgttaccaacctaanagtaactaccggccgctcnggtacgaaaggtcaagtatctaatttanccttaagaaagtgtaattaggtaatttaaacgaaaacgttactcaacttagttaacaccggtaanaacgtaaacgtaacgaacgaacgaaccgtaaacgaaaaccggaaacggaaaccgtaaccggtaccggtacgttaacgttacgttacgtaacgtacgtaacggtacgtaacgtaaccgttaacggtaacgtaaccg

SEQ ID NO: 311716 - DNA, 523 bp, Homo sapiens
  misc_feature: GZ8MTXP02G0XRZ.25.36.D03.1.454.CMB.2.raw
  modified_base (242)..(242): a, c, t, g, unknown or other
  misc_feature (242)..(242): n is a, c, g, or t
  modified_base (305)..(305): a, c, t, g, unknown or other
  misc_feature (305)..(305): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggncttataactatgtctcctggtcccaacaacacccaggccaacggcccccaaatcatcatttangatgtcagtcatcggccctctggagtttcctggtcgcttctctggctccaagtctggcaactcggcctccctgacccatccgtcggggctcccgaggcctggaggacgagcttaacgttattatgctattcatacagacgacacanagtcgtggtcgtcggnggaggaccaagttcgacgtccgtcggcacgaccgaggcctccgcccctcggtaccc

SEQ ID NO: 311717 - DNA, 704 bp, Homo sapiens
  misc_feature: GZ8MTXP02IYKWC.25.36.D03.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagctccgacgtcggaaatagttgtctactggtaccagcagcctcccaagaaaccggcccccaagcctcctcatctataggaatgatcgagccggccctacgacgggactaccgtgaacccgtattccgtctcgggccttacggaaacgttccgtcgggcccttcccgtcccgggtccccttccccgtcggcccctaagtccgtaagggtcggggtcccttcccgggggtacccgaagggtacgttgggaaacggggtccttaaggaaaatttacgttaacccgttggttcggtaccgttaaggggtttttggggaactttcggacccgtaaggttccgtggtaacgggttcggggtacccgggtacggggttcggttaccgggggacggggtaacggggaacccgtaaagggtccgttacgggaccccggttaccgtacggggtaccaaccggtaccccgtaaccggg

SEQ ID NO: 311718 - DNA, 650 bp, Homo sapiens
  misc_feature: GZ8MTXP02GK4P6.25.36.D03.1.454.CMB.2.raw
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (321)..(321): a, c, t, g, unknown or other
  misc_feature (321)..(321): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtgctgactcagccaccctcagtgtcgtcggggaccccccggnaggaggtctccatctcttgttctgggancagctcgacgtacgaaatagttgtctactggtaccagcacgcctacccaacgaaacccggcccccaaagcctcctcatctanaggaatgatcagcccggccctgacggactaccgtagaccgtattctcgtcggctacggaagtcgtggtcctcccgtcgccctcccgtacggccagtcgtagtcggggccctccgggtaccggaggtacgtaggacggtcgtagtaaacttagttacttggtgtacgttaggtttagggattcggaccgtagttcgtagtacgggttcgggtaccgggtacgggttcggttcggggaccggggaacggggtaaacccgtaacggtccggttaccgggtaaccccggttcggttaaccgggtaccgaaccggtaccccggtaaacccgggg

SEQ ID NO: 311719 - DNA, 530 bp, Homo sapiens
  misc_feature: GZ8MTXP02GQ9JM.25.36.D03.1.454.CMB.2.raw
  modified_base (306)..(306): a, c, t, g, unknown or other
  misc_feature (306)..(306): n is a, c, g, or t
  modified_base (437)..(437): a, c, t, g, unknown or other
  misc_feature (437)..(437): n is a, c, g, or t
tcagactgtacagtcacgaccggtgctcgatttagctgcgtcacgatctctcttggggagctctgcgagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggagtccctgagactctcctgtgaagcctctggatttagttcagtggttctggcatgcacgtgggtccncaggctccgaggcaaggggccgagtgggttggcctagttatagcacatgatgggaaagttctagaattattatgcagactccgtagaagggccgattcacatctaccagacgacaaacgttccccggaaanattgtagtacgttaggaaatggtcagcctggaacgagtcgaggactcggctcgtagtattacgtgtcgacgagagtcgggggagttggttaag

SEQ ID NO: 311720 - DNA, 674 bp, Homo sapiens
  misc_feature: GZ8MTXP02HVOUE.25.36.D03.1.454.CMB.2.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtggtgactcagccaccctcagcgtctgggacccccggnagacggtcaccctntcttgtctggaancagctccaatctcggaactaacnctgtgaactggtaccagcaggtcccaggatcggaccccccaaatttcacatttatagttagttatcagtccaaccctcgacggggtcccctagacccccgtatttcctcgtacggcttaccccgaagttcctagggcctaccctccgaacgtccccctcccgttgggaccctagtccgaggtcgggggtcccagtcgtacggaggacttggacggtctaggtcctttaagttacgttgaccgcgtacggcaaggttcgggaatcgaacgtgtaccctaggtaacgttggggttcggttcggggtttttaccggggaacggggttacggggaacccgtaaagggtccgttaacggggtaaccccggttaccggttaaccggggttaccgaaccgggaccccgttaaacgggtcccccgg

SEQ ID NO: 311721 - DNA, 755 bp, Homo sapiens
  misc_feature: GZ8MTXP02H5536.25.36.D03.1.454.CMB.2.raw
  modified_base (207)..(207): a, c, t, g, unknown or other
  misc_feature (207)..(207): n is a, c, g, or t
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggagcagctccgacgtcggaaatagtttgctactggtaccagcagctcccagaacggccccaagctccncatctaataggaatgatcagccggccctnacggggatacccgtgaccgtattctctgggcctcgaacgttctgggcctccgtccgggccccttcccgtcggaccctactccgacggttcggggcccgttccccggggtacccggacgggtagttcgggaacgggtaccgtttacgggtaaaactttagttttaaaccccgtgggttttacggaccggttaaagggtttttggggggaaacttacggcccccgtaaagggttcccgtttacgggggtaacggtttcgggggtttacccccggggtaagggggtttaccggggtttccgggggtacccgggggaaacgggggtaaacccccgaaaaggggttccccggtaccggggttaaaccccggtttccccggttaaacggggggttcccaaccggggtttaaaccccccggtaaacccggggg

SEQ ID NO: 311722 - DNA, 524 bp, Homo sapiens
  misc_feature: GZ8MTXP02H50MI.25.36.D03.1.454.CMB.2.raw
  modified_base (219)..(219): a, c, t, g, unknown or other
  misc_feature (219)..(219): n is a, c, g, or t
  modified_base (279)..(279): a, c, t, g, unknown or other
  misc_feature (279)..(279): n is a, c, g, or t
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
  modified_base (417)..(417): a, c, t, g, unknown or other
  misc_feature (417)..(417): n is a, c, g, or t
  modified_base (499)..(499): a, c, t, g, unknown or other
  misc_feature (499)..(499): n is a, c, g, or t
tcagactgtacagtcacgaccggtgctcgatttagctgcgtcacgatctctcttgggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagagcctggggcctnagtgaaggtctcctgcaggcttctggttacacctttagcagctatggcatcagctgggtncgacacggcccctggacaagggcttgagtggatggcagtggatcagcccttaaacgatggtatcacagtactatgcaanaggaacttccgagggcagacgtcactgaccanacgacacactccacgagcacagcctanagtcgacctagagacgtccaggcgatcgagaacgaccgacgggtaccttatacttacgtcggtgcgtagacgtaagattacncgtacgttacgtcgtacggtacccg

SEQ ID NO: 311723 - DNA, 630 bp, Homo sapiens
  misc_feature: GZ8MTXP02HPJWP.25.36.D03.1.454.CMB.2.raw
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggactccgccagtccggcgggagggactggagtggattgggcgtatatatacgaatggattaaccactacacgcccctcctcaagngtcgagtcaccatacncagcgacacgtcgaggactcgaggtcttccngctatctgtcttcgngcgacgtcgccccgacgaccnccgtacctatacctacgtgcgacagagtcgttacgatgcgtacgttagtttagaagttaatttatttattcgtttgttcgttcgtttgactaggttcgggtacgggtacggtaaggggtaccggtacgggtacctaccgttctcgttcgacgtcccgtaccgaaccgaaccggtacccgtacggttcccggttccccttccccgtccgtaccccgtacccctacccgtaccgaaccggtaccgtacccgtacccggttccggtacggggacccgtacggccgg

SEQ ID NO: 311724 - DNA, 635 bp, Homo sapiens
  misc_feature: GZ8MTXP02INJTR.25.36.D03.1.454.CMB.2.raw
  modified_base (180)..(180): a, c, t, g, unknown or other
  misc_feature (180)..(180): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
  modified_base (371)..(371): a, c, t, g, unknown or other
  misc_feature (371)..(371): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggttttcttctgaactgactcaggacccccgntgtgtctggtggccttgggacagacagtcaggatcacatgaccaaggagacagcctcaagtaacttattatgctatcctggtaccagcagaacgccggacacggcccctntactgtcttctacggtanaaaaccncccgccctgaggatcctcagacctattcctcgtcgcctccgcctacgaacgaaccncacgtccttaccctgacctatccgacgtggggcctacgacggcgacaaagctagacgtaacgtagaactttaatttaccgttcgttacccccggtacccgggactacccgtaagggtacggtaacgtccgttagggtttcggttggttaccgttcggggacggtaacgggacccgtaaagggtccggtaccgtaccgttacgggtacaccggtacccgaaggtccctcccggtcccccgttcggtacctaccgttcttaccccg

SEQ ID NO: 311725 - DNA, 627 bp, Homo sapiens
  misc_feature: GZ8MTXP02JIKYI.25.36.D03.1.454.CMB.2.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (303)..(303): a, c, t, g, unknown or other
  misc_feature (303)..(303): n is a, c, g, or t
  modified_base (476)..(476): a, c, t, g, unknown or other
  misc_feature (476)..(476): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtctccatctcttgttctgggancagctccgagtcggaaatagttgctactggtaccagcagctcccaagaaccggccccaagcctccncatctataggaatgatcagccggccctgaggactacctgaccgtattcctctgggctacggaacgtcgtcggccttccgtccgggcccttccccgtcggacccactcgacggtcgggcccgttacccgggtccgagggacgtcggaacggtcttaaggtaattacgtttacgngggttacgacgttaggggtttgggaacttcggacccgtagtccgtaggtacgggtcgggtacccgggtacgggttcgggttcggggacgggaacgggtacccgaaggtccgtacggtacccggtcgttaggccaaccggtacccaaccggg

SEQ ID NO: 311726 - DNA, 570 bp, Homo sapiens
  misc_feature: GZ8MTXP02FM3CE.25.36.D03.1.454.CMB.2.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (437)..(437): a, c, t, g, unknown or other
  misc_feature (437)..(437): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtctccatctcttgttctgggancagctccgacgtcggaaatagttgtctactggtaccagcagctcccagaaccggcccccaagcctcctcatctatagaatgatcagcggccctgacgggactacctgaccgtattcctctggctcgaagtctggctcctcggccctcccgtaggcccagtcaggtcgggcctccgggtcgaggatcggaggctagaattnttacgtgtgcgtaggtttgggattcgccgtagtcgtggaggttcggtccggtacgggttggttacggggcggggaacgggacccaaaggccgtacggaacccgtcgtaaggtccgaaccggccccgaaacggg

SEQ ID NO: 311727 - DNA, 550 bp, Homo sapiens
  misc_feature: GZ8MTXP02GYRZQ.25.36.D03.1.454.CMB.2.raw
  modified_base (369)..(369): a, c, t, g, unknown or other
  misc_feature (369)..(369): n is a, c, g, or t
  modified_base (516)..(516): a, c, t, g, unknown or other
  misc_feature (516)..(516): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggttttccttgttgttatttttccaggtgtccagagtgaggtgcaggttggtggagtcgtgggggaggcttgggtccagccgtgggagggtccgtgagagtctcctgtgcagcctctggattcatcttcagtcgaccatacagtggactgggtccgcaggctcgagggagggctggagtggtgccgtatagaaataagctaagatcaccanagatacgcgcgtctgtagaaaggcagattcattatctacgaagagatagaatttacaaaagtaactactatacgtatctagactaaaatgaaactacgaacctaacgaaaacccggaggaaaccacggaccgttacgtattaactgngtactaggtacaacgtacgtacgggtactaaccc

SEQ ID NO: 311728 - DNA, 537 bp, Homo sapiens
  misc_feature: GZ8MTXP02G3H7V.25.36.D03.1.454.CMB.2.raw
  modified_base (208)..(208): a, c, t, g, unknown or other
  misc_feature (208)..(208): n is a, c, g, or t
  modified_base (508)..(508): a, c, t, g, unknown or other
  misc_feature (508)..(508): n is a, c, g, or t
  modified_base (531)..(531): a, c, t, g, unknown or other
  misc_feature (531)..(531): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggttttccttgttgttattttccaggtgtccagagtgaggtgcagttggnggagtcgtgggggagcttggtccagcctggagggtccgtgagagtctcctgtgcagcctctggattcatctcagtgaccatacatggactggggtccgccaggctccgaggggaaggggctgggagtgggtgcccgtattagaaataagctaagagtacaccacaagaatacgcgatcagtagaaaggcaagattcattatctacaaagagatagattaccaaaagtaactctaactagtactctagaacaaatagaaacagaccaagaaaaccgaggaccacggccgtagtactctagngacgtaggtacagtactacggtntaaccc

SEQ ID NO: 311729 - DNA, 537 bp, Homo sapiens
  misc_feature: GZ8MTXP02F8KHL.25.36.D03.1.454.CMB.2.raw
  modified_base (246)..(246): a, c, t, g, unknown or other
  misc_feature (246)..(246): n is a, c, g, or t
  modified_base (308)..(308): a, c, t, g, unknown or other
  misc_feature (308)..(308): n is a, c, g, or t
  modified_base (345)..(345): a, c, t, g, unknown or other
  misc_feature (345)..(345): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattgggtncttaataactatgtctcctggtcccaacaacacccagcaacggcccccaaatcatcatttangatgtcagtcatccggcctctggtactttcgtggtcncttctctcggctccaatctggacctaacgtcggcctccctgaccctagtccgtcggggctccgaggctggaggacgagcttaacttattatgactatttnatacaganacacacagtctggtgttcggacggacggtaaccagttcgacccgtcgttcgaacgacgacccgaggtcctccgcccctggtccc

SEQ ID NO: 311730 - DNA, 565 bp, Homo sapiens
  misc_feature: GZ8MTXP02H9CZG.25.36.D03.1.454.CMB.2.raw
  modified_base (269)..(269): a, c, t, g, unknown or other
  misc_feature (269)..(269): n is a, c, g, or t
  modified_base (311)..(311): a, c, t, g, unknown or other
  misc_feature (311)..(311): n is a, c, g, or t
  modified_base (415)..(415): a, c, t, g, unknown or other
  misc_feature (415)..(415): n is a, c, g, or t
  modified_base (495)..(495): a, c, t, g, unknown or other
  misc_feature (495)..(495): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcgtgggtttccttgttgttattttccaggtgtccagagtgaggtgcagttggtggagtcgtgggggagcttggtccagcctgggagggtccgtgagagtctcctgtgcagcctntggattcatcttcagtgacccactacatggactcggggtccncaggctccgaggggaggggctgggagtggggtcggcccgtattagaaataaagctaaagattacaccacagaatccgcgcgtctgagaaaggcagattcattanctacaagagtatagtaattacgaaagtaactcactgtaactctagacaaagtagaaacacgacctaaacgaaaacccggnggaaccgaacggccggtataacttaacgtgtaacggacttaggtacgagtaccgttacggtacgtaaccc

SEQ ID NO: 311731 - DNA, 683 bp, Homo sapiens
  misc_feature: GZ8MTXP02F5JWP.25.36.D03.1.454.CMB.2.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
  modified_base (280)..(280): a, c, t, g, unknown or other
  misc_feature (280)..(280): n is a, c, g, or t
  modified_base (364)..(364): a, c, t, g, unknown or other
  misc_feature (364)..(364): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcgggacccccgggnaggagggtctccatctcttgttcgtgggancagctccgacgtcggaaattaagttgtctacgtggtaccngcagctacccaagaaccggcccccaagcctcctcatctataggaatgatcagccggccctcgacgggactaccgtgaacccgtnttccgtctgggcctacggtaacgttcctgggccctcccgtcccgggtccccttcccgtcggaccctagtccgaggtcgggtcccgtacccgggtccggtaggacgttcggaaacgggtccttaggtaaaactttagtttaaccgtggttacgtaccgtaagggtttttggggaacttcggtacccgtaaggtttccgtagggtaacggttccggggttaccgggtacggggtttcgggttccggggacgggaacggggtacccaaaggtccgtacggtacccggttaccggtacggtaccgaaccggtaccccgaacgg

SEQ ID NO: 311732 - DNA, 523 bp, Homo sapiens
  misc_feature: GZ8MTXP02FT04L.25.36.D03.1.454.CMB.2.raw
  modified_base (307)..(307): a, c, t, g, unknown or other
  misc_feature (307)..(307): n is a, c, g, or t
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
  modified_base (480)..(480): a, c, t, g, unknown or other
  misc_feature (480)..(480): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggaggtccctgagactctcctgtgaagcctctggatttagttcagtggttctggcatgcactgggtcccnccaggctccagggcaaggggccgagtggtggcagttanagcacatgatgggaattcagaatattangcagactcgtgaacggccgattcaccatctccagacgaactaacttccccgggaatagttgtagtacttaggaaatggtacagcctagagtagtcgaggtactcggntctgtacttcgtgtgcgagacggtcgggaggtggtagttacgg

SEQ ID NO: 311733 - DNA, 628 bp, Homo sapiens
  misc_feature: GZ8MTXP02GOCZL.25.36.D03.1.454.CMB.2.raw
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagcgtgggtgcgacgacggcccctaggaccaagggtcttggagtggatggcagtggatcgagtaccttaaacagttcggtaactcaacgacggtaactagtgacctaacgaacgggtaactttcccgaaggggcaacggacggttacccaccgtttacggaacccaacgaacgaaccaacaacctcccgaacgacgaccaaccgacgaccctaacacgttcggaccctagggacggacgaccgtaggacgtaacttcgacggaaccgtaaccgtacgggtaccctttaagtacttaaccgtgtcgacgtagtacgtaacgtattacgtcgtacgtttaccgtcggttacgtaccccg

SEQ ID NO: 311734 - DNA, 716 bp, Homo sapiens
  misc_feature: GZ8MTXP02IHY0P.25.36.D03.1.454.CMB.2.raw
  modified_base (227)..(227): a, c, t, g, unknown or other
  misc_feature (227)..(227): n is a, c, g, or t
  modified_base (243)..(243): a, c, t, g, unknown or other
  misc_feature (243)..(243): n is a, c, g, or t
tcagactgtacagtcacgaccggtgctcgatttagctgcgtcacgatctctcgttgggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcgtcaccatctcctgcactggaaccngccgtgactattggtncttaataactatgtctcctcggtacccaacaaccacccaggaccaacggacccccaaatcatcattatgatgtcagtcatccggcctgtggtagtttcctcggtcgtcttctctggtacctccaagttctacggtacctaaccgtcccggcccttccctcgaccctacgttcccgtcccgggggtccttcccgaggtccgtacggaacgggaaccggtacgggttacctttaaacgtttaagtttaactttacggtaccttaacgttttaccaacgtttaaacaaacggttaacgaaaacccaaacctaaaacgtaaacgtttcgtaacggggtttcggttacccggggtaacggggaaaccgggttaaaccccgtaaaggttccggtaaaccccgttccggttaccggtaacccgtaaccggaaccccggtaaacgggtccccgtcccgtacccccggtttacggtaccccg

SEQ ID NO: 311735 - DNA, 586 bp, Homo sapiens
  misc_feature: GZ8MTXP02IMPUU.25.36.D03.1.454.CMB.2.raw
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (502)..(502): a, c, t, g, unknown or other
  misc_feature (502)..(502): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcggggaccccccggnaggagggtctccatctcttgttctgggancagctccgacgtacggaaattagttgtctactggtaccagcagcctacccaagaaaccgccccaagcctccnatctanagaatgatcacgccgccctgacgggactaccgtgaaccgtattcgtcgtcggcctacgaacgttctcgggcctcccgtccgggccctcccgtaggccctagtccgaggttcgggccgtccgggtccgagggactggacggtctagtaattattacgtgtgcgtaggtttggatcggcctagtcnggtacgtcggtccggtacggtcggttcgggacgggacgggaccagccgtagacccggttcgtacggccacggacccgaaccggg

SEQ ID NO: 311736 - DNA, 519 bp, Homo sapiens
  misc_feature: GZ8MTXP02FLNFZ.25.36.D03.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggancagctccgacgtcggaaataagtttgctactggtaccagcagctcccagaaaccggcccccaaagctcctcatctataggaatgatcagcggcccctnagggatacctgaccgattcnctggctcgaaagtctgctcctcggcctccctggccatcagtgggctcggtccgaggatgaggcngatatatgtgngtagttggtgtgcagtcgtgtagtggtcggtacggtcggttcggcggacgggacgaacgcgtcgaccgtacgtacgtacgacgaccgaacg

SEQ ID NO: 311737 - DNA, 704 bp, Homo sapiens
  misc_feature: GZ8MTXP02G5L3K.25.36.D03.1.454.CMB.2.raw
  modified_base (321)..(321): a, c, t, g, unknown or other
  misc_feature (321)..(321): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacaggtcgtcaccatctcctgcacgtggaaccagccgtgactagttggtgtacttaatactatcgtcctcctcgtacccaacaaccaccgaggaccaacggacccccaaactcactactattanatatgcagtcacgtccgcctcgtggttacgtttccgtcggtccgtcttctcgtacggcctccgtaagttcgtcggtacctaaccgtcccggtccccttcccgtacgtacccgtacgttcccgggtccgggggtccttcccgaggtccgtacgggaacggtacggtacgtactttaacgtttatttacgttgtacttatttacaacgttaacgaacgtaacgaacaaccgtaaaccgtagtacggttcggggttacggttaccgggggacgggaaacgggtaaaccgttaacgggtttaccggaacccggtttccgaccgggttaaccgaaccggacccggtaaccggtcccggttacccgtacccccggttacggtttccccg

SEQ ID NO: 311738 - DNA, 644 bp, Homo sapiens
  misc_feature: GZ8MTXP02HITOT.25.36.D03.1.454.CMB.2.raw
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (325)..(325): a, c, t, g, unknown or other
  misc_feature (325)..(325): n is a, c, g, or t
  modified_base (387)..(387): a, c, t, g, unknown or other
  misc_feature (387)..(387): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcggtcaccatctcctgcactggaaccagccgtgacagttggncttataactatgtctcctggtcccaacaacacccagcaacggcccccaaactcatcatttangatgtnagtcatccgccctntggtatttccgtgtcgtcttctcgtcggctccaagtctcggacaaccgtccggcccttcccngtacccagttcccgtcgggggccttcccgaggtcgtggaacgggacgaggtccttaaacgtttatttattacgtcttattttacaacgttaacgaagtaacgaccctaaaccgtaacgtaacggttccgttgggttacggttacggggaccggggtaaacgggaccgttaaacggttccgaaccccggttccgtaccggggtaaccgaaccggaccccggaaacggtcccgtacccggtcccccgttcgggtacccc

SEQ ID NO: 311739 - DNA, 549 bp, Homo sapiens
  misc_feature: GZ8MTXP02G92E6.25.36.D03.1.454.CMB.2.raw
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (322)..(322): a, c, t, g, unknown or other
  misc_feature (322)..(322): n is a, c, g, or t
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccgccgggagggactggagtggattgggcgtatatatacgaatggattaaccactacaacccctcctnaagngtcgagtcaccatatcagcggacacgtccagggatcaggtnttccngcatctgactttcngcgactgccgcggacncggccctatacctactgtcgccagngtacttcgggactgacgacgtagttttcggagtaattattatctttgtgtctttgactagtgtgggaccgaagggacgacggtcgaccgtctcttcacgcctaccaccgaacggcccacgtccggtccttcccccgtcggcctaccctcctaccaacgcgcaccgtcgtcggggcacgacgcccgg

SEQ ID NO: 311740 - DNA, 539 bp, Homo sapiens
  misc_feature: GZ8MTXP02GBXYV.25.36.D03.1.454.CMB.2.raw
  modified_base (211)..(211): a, c, t, g, unknown or other
  misc_feature (211)..(211): n is a, c, g, or t
  modified_base (307)..(307): a, c, t, g, unknown or other
  misc_feature (307)..(307): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (460)..(460): a, c, t, g, unknown or other
  misc_feature (460)..(460): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagcccaccctcagtgtctcgggggccccccggnaggagggtcgacattctcttgttctggaagtcgctccaacgtcggcagtaatagtgtaaagctggtaccagcaactccccaggaacccgcccccanacctcctcatgtatgggaatgatcagccgcccctcgacggggtccccngaacccgtnttccnctcgccctccacgtctgcacctcacgccctccctgccagtccgtggcctacaatcgngagatgagcctattatnttgngcgagngtggagngagaagaagtaagtagtgtacgttacgtagtacggtacgaagtaacgacgtacgtacgtacgacgaccgacgaaccccg

SEQ ID NO: 311741 - DNA, 504 bp, Homo sapiens
  misc_feature: GZ8MTXP02JGVJY.25.36.D03.1.454.CMB.2.raw
  modified_base (428)..(428): a, c, t, g, unknown or other
  misc_feature (428)..(428): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacaggatcccgggctcagtctgccctgactcagcctcgctcagtgtccgggtctcctggacagtcagtcaccatctcctgcactggaaccagaagtgatcttggtgcttatgacactgtctcctggcaccagttttacccaggaaaagcccccagagtcatcctttatcgatgtcaggaagcgccctcgacggggtccccctgatcgcttctctgggtccaaatctggcaacacggcctccctgaccatctctgggctccaggctgagatgaggctgattgtattgctgtcntatgcagcaactactatttggtcgttcggcgtcgacgggacctagtgaccgtccgtgggtacacgccaaggtcccg

SEQ ID NO: 311742 - DNA, 590 bp, Homo sapiens
  misc_feature: GZ8MTXP02GISVD.25.36.D03.1.454.CMB.2.raw
  modified_base (230)..(230): a, c, t, g, unknown or other
  misc_feature (230)..(230): n is a, c, g, or t
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtcgtccggtctccgtggacagtcggtcaccatctcctgcactggaaccngccgtgactattggtgcttataactatgtctctcgtcccaacaaccaccaggacaacggccccaaactcatcatttatgatgtcagtcatccgcctctggtagttcgtgtcgtcttctctggctcaagtctcggctaaccgtcgccctcctcgaccctacgtccgtccgggggtcctccgacggtccgtagggacggacggacggtacttaacgttattagttcgtacttatttaccaatacgagaacgacaaccaacgtacgttccgtggttacggttccgggacggtaacgggtacctaacgttcggaacccgtcgtaccggtacgaccggacccgtaacggtccgtaccgtcccccg

SEQ ID NO: 311743 - DNA, 574 bp, Homo sapiens
  misc_feature: GZ8MTXP02JR8MM.25.36.D03.1.454.CMB.2.raw
  modified_base (243)..(243): a, c, t, g, unknown or other
  misc_feature (243)..(243): n is a, c, g, or t
  modified_base (300)..(301): a, c, t, g, unknown or other
  misc_feature (300)..(301): n is a, c, g, or t
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (363)..(363): a, c, t, g, unknown or other
  misc_feature (363)..(363): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcacatctctgcactggaaccagccgtgactagttggtntacttataactatgtctcctgtccaacacaccagcaacggccccaaatcatcattannatgtcagtcatcgcctntggtatttctgtcncttctctgctcagtctggctactcgcctccncgaccatcgtcggctcgagctagacggtacgaggtcttaacgttattattcgtcttactttctaattaacgacgtaacgaccaacctaacacgtacgtcggttacggttacggggacggtaacggggaaccgtaaacgggtttacgacccggttacccgtacggtaacgaccggtacccgaacggtcctcccgtccccgttacggtacccg

SEQ ID NO: 311744 - DNA, 559 bp, Homo sapiens
  misc_feature: GZ8MTXP02JH4MI.25.36.D03.1.454.CMB.2.raw
  modified_base (243)..(243): a, c, t, g, unknown or other
  misc_feature (243)..(243): n is a, c, g, or t
  modified_base (302)..(302): a, c, t, g, unknown or other
  misc_feature (302)..(302): n is a, c, g, or t
  modified_base (464)..(464): a, c, t, g, unknown or other
  misc_feature (464)..(464): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctgtcccaacaacacccaggcaagcccccaaatcatcatttangatgtcagtcatccggccctcgtggtagtttcctggtcgtcttctctggctccaagtctggccaacgtcggccctccctgaccctagtccgtcggggcctcccgaggcctggacggacgaggtcttaacgttatattgctatttcatacagacgacaccaanagtcgtaggtcgttcgggacggtacgggacctaaaggttcgacccgttccgtcggtccgacggtacccaacggtcctaccgcccccgtggtaccc

SEQ ID NO: 311745 - DNA, 517 bp, Homo sapiens
  misc_feature: GZ8MTXP02FK7RZ.25.36.D03.1.454.CMB.2.raw
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
  modified_base (342)..(342): a, c, t, g, unknown or other
  misc_feature (342)..(342): n is a, c, g, or t
  modified_base (451)..(451): a, c, t, g, unknown or other
  misc_feature (451)..(451): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtncttataactatgtctcctgtcccaacaacacccaggcaacggcccccaaactcatcatttangatgtcagtcatcggccctntggtagtttcctggtcncttctctggctccaagtctggccaactcggcctccctgaccatccgtcgggctcccgaggctggaggacgagcttacgttattatgctatttcatacagacgacacaanagtctggtcgtcggcggacggactagtcgacctcgtcgtcgacgcccaaggcctcgccccgtgtcc

SEQ ID NO: 311746 - DNA, 656 bp, Homo sapiens
  misc_feature: GZ8MTXP02IA2L6.25.36.D03.1.454.CMB.2.raw
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctcgtgtctggactcctggacagtcggtcacatctcctgcactggaaccagccgtgactagttggtgtcttaataactatgtctcctgtcccaacaacaccagcaacgcccccaaancatcattangatgtcagtcatcggccctcgtggtagtttcctggttcgtcttctcttggccttccgaaagttctcggtacaacctccggccctccctacgacccatccgtcggggtcctcccgaggtcgtacggacggacggtacggtacttaaaccgtttatttaaacgttggtaccttaatttacaaattaaccgaaaggaacgtaaaccaaacctaaacgacggttcgtacgggtttacgttaccggggacggggaaacggtaacccgaaaagggtttccgaaccccggtttccgtaccggtccgaacggtaccccgaaaagggtcccgttcccggtaacccccgtttccgggtaacccc

SEQ ID NO: 311747 - DNA, 627 bp, Homo sapiens
  misc_feature: GZ8MTXP02JNXOS.25.36.D03.1.454.CMB.2.raw
  modified_base (208)..(208): a, c, t, g, unknown or other
  misc_feature (208)..(208): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtctccatctcttgttctggagcagctccgacgtcggaaatagttgctacgtggtaccagcagcctcccaagaaaccggccccaagcctccctcactctataggaatgatcgagccgcctnacgggactaccgngaccattcctntggctagagtcngctccgtcggccctccctggccatccagtcggcctccgggtccgagagtggacggtactggtaaattcgttaacgtgggtgtacgtaaggttttcgggaacgtcgtaccgtagtccgttgggtacggttcgggttacccgggtacgggttcggggtttaccggggacggggtaaccgggaaccccgtaaaaggtcccgtaacgggtaccccggttaccggtacgggttaccgaacccgggtacccggaaacccggg

SEQ ID NO: 311748 - DNA, 642 bp, Homo sapiens
  misc_feature: GZ8MTXP02HXDJ0.25.36.D03.1.454.CMB.2.raw
  modified_base (189)..(189): a, c, t, g, unknown or other
  misc_feature (189)..(189): n is a, c, g, or t
  modified_base (210)..(210): a, c, t, g, unknown or other
  misc_feature (210)..(210): n is a, c, g, or t
  modified_base (378)..(378): a, c, t, g, unknown or other
  misc_feature (378)..(378): n is a, c, g, or t
  modified_base (465)..(465): a, c, t, g, unknown or other
  misc_feature (465)..(465): n is a, c, g, or t
  modified_base (489)..(489): a, c, t, g, unknown or other
  misc_feature (489)..(489): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagcccaccctnagtgtcgtcggggcccccggnaggagggtcacatctcttgttctggaagtcgctaccaacgtcggactagtaatagtagtaagcgtaggtaaccagaccaacctccccgaagggaacccgcccccacacctcctacagtgtagtgggaatgactcgacgcccgcccgtcgaccggggtccctgaccgtnttcctcgtggctacgtaacgtccgtggtcctccgtccgccctccgtcggccacgtcgtaggtcgggcccgttccgggcggacgtagnggagtcgtttttaagaaacgtttnttacgtgtacgtacgttaggtttaggactcggaccgtagtcgtaggtacgggttcggtaccgggttacgggttcgggttacgggaccggggtaacggaaccgtaacggccgtacggtacccgttacggtaacggtcccgacgtaccccgacgg

SEQ ID NO: 311749 - DNA, 682 bp, Homo sapiens
  misc_feature: GZ8MTXP02HBE61.25.36.D03.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnaggaggtctccatctcttgttctgggancagcctccgacgtacggaaattagttgtctacgtggtaccagcacgcctacccgaaggaaaccggcccccaaagtcctcctcaatctaagtacggaatgactcgacgccggaccctgacggtactaccgtgaccgtattcctcgtcgggccttacggaacgttccgtcgggtaccctcccgtcccgggtccctacccgtcggaccctagtcgtaacgggtcgggcccgttccgggtaccggaggagtcggacgggtaccttaggtaaatttacgttacgtgggtcgtacggttaggttttggggaatttccggccgtaaggtctaaggggtacggttcgggtcccgggtaggggtttcggttacgggggacgggtaaccgggacccgtaaaggtccgttacggtaacccggttcggttaccggaccgccggtaaccccgtaaccggg

SEQ ID NO: 311750 - DNA, 554 bp, Homo sapiens
  misc_feature: GZ8MTXP02IU5UF.25.36.D03.1.454.CMB.2.raw
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (399)..(399): a, c, t, g, unknown or other
  misc_feature (399)..(399): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcgagtgaaggtctcctgcaaggtcttcgtggttacacctttagcagctatggcatcagcgtgggtgcgacgacggcccctggaccaagggcttaggagtggatggcagtggatcagtcctaacntgtatcacagactangcagaaggtaactccgaagggcagtacgtccactacgaccanagaaccactacaccgaacgacgactacgacgacctaacagtacgacctaggagcgacgtgaagctacgacgaacgacgtacggtaccgttatacgttacgtgtacgacgagtacgtcgtaattacgtcgtaccttaccggtaccgttcgtacccg

SEQ ID NO: 311751 - DNA, 634 bp, Homo sapiens
  misc_feature: GZ8MTXP02JCMGF.25.36.D03.1.454.CMB.2.raw
  modified_base (210)..(210): a, c, t, g, unknown or other
  misc_feature (210)..(210): n is a, c, g, or t
  modified_base (341)..(341): a, c, t, g, unknown or other
  misc_feature (341)..(341): n is a, c, g, or t
  modified_base (480)..(480): a, c, t, g, unknown or other
  misc_feature (480)..(480): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctcagtgtcgtcggggacccccggnaggagggtcctccatctcttgttcgtgggagcagctccgacgtcggaaattagttgtctactggtaccagcagcctacccaagaaaccggcccccaagcctcctcatctataggaatgatcagccgcctanacgggactaccgtgaaccgtattctcgtcggacctacggaagttcctgggtcccttcccgtccggtccctcccgtcggcccacgtcgaggtcggcccgtccggtccgaggatcggaaggcttagtaaattacgtttacngggttagtacggttaggtttacggggattcggtaccgtaagttcgtggacggttcgggtacccgggtaggggttcggttaccggggcgggaacgggacccgtaaggccgttacggaccccggttacgtagggtcccgacggaccccggtaacgg

SEQ ID NO: 311752 - DNA, 612 bp, Homo sapiens
  misc_feature: GZ8MTXP02HBRIM.25.36.D03.1.454.CMB.2.raw
  modified_base (288)..(288): a, c, t, g, unknown or other
  misc_feature (288)..(288): n is a, c, g, or t
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcgttggtgcttatgacactgtctcctggcacctagtttacccaaggaaacncccccagacgtcatcctttatgatgtcaggaagccgcctcgaccggggtccctgactcgcttacctcgtcggggtacctaaatcgtagggaccaacgacccggtcccttaccccgtcgaaccctacttccgtcgtcggggtcctcccgaggtcctagggagagttaggaggtctagttatttatttagttgcgtttgttactattagttgaccgtaggtacctaaacttacgtttagttttcgggttgtttccggacggtacgaacgggtacgtaacggttcggaacccgttcgtcgggttaccacggttaccccgtaaccggg

SEQ ID NO: 311753 - DNA, 639 bp, Homo sapiens
  misc_feature: GZ8MTXP02GIF86.25.36.D03.1.454.CMB.2.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (323)..(323): a, c, t, g, unknown or other
  misc_feature (323)..(323): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccggnagagggtctccatctcttgttctgggancagctccgacgtcggaaatagttgtctactggtaccagcagctcccagaaccggccccaagctcctcatctatagatgatcagcgcctnacgggatacctgaccgtattcctctggctcgaacgttcgtcggctccgtccggccctcccgtacggccaatcgaggttcgggccgttccgggtccggaggacgttggaacgggtcctaggtaaatttagttaaccgtgggttcgacgttagggttttgggggatttacggcccgtaaggttccgtaggtacgggttcgggttcccgggtaacggggtttcgggtttccggggacggggtaaacgggtacccgtaaaggccgttacgggtaacccgttacccggtaaggttcccgaacggtacccccgtaaacgggg

SEQ ID NO: 311754 - DNA, 581 bp, Homo sapiens
  misc_feature: GZ8MTXP02G4CN8.25.36.D03.1.454.CMB.2.raw
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgcagtccgccgggagggactggagtggattgggcgtatatatacgaatggattaaccacctacaacccctcctnaagngtcgagtcaccatatcagcggacacgtccagggatcgaggtntcctgcatctgacttctgctactgccgccggacaccggccctatacctactgtcgccagacgattccgggatgcgtacgtattttacggagtaattattattctttgtgttcttttgactagttggtagggaccgaaggggtacgacggttcgaacccgtccttcttcacgtccctaccaaccgaacgggcccctaacgtcccggtccttcccccgtcggccctacccctcctaccgaaacgcgaccacccgtcgtcggggaccaacgacggcccgg

SEQ ID NO: 311755 - DNA, 637 bp, Homo sapiens
  misc_feature: GZ8MTXP02GIWF6.25.36.D03.1.454.CMB.2.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
  modified_base (338)..(338): a, c, t, g, unknown or other
  misc_feature (338)..(338): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggancagctccgacgtcggaaatagttgctactggtaccagcagctcccgagaaaccggcccccaagctcctcatctataggaatgatcagcgcctgaggactaccngaccgtattcctctcgggctcgaagtccgtggcctccgtccggtccctccctcggcctatcgagtcgggcctcccgggtccgaggacgtggaaggtctaggaattacgttacgtggttacgaccgttaggttttcggggacttcggacccgtaggttccgtggtaacgggttccgggtccggtaacggggtttcggtttacgggggacccggggtaaagggggacccctaaagggcccgttacgggaaacccggttccgtaaacggggttccaaaccggggtacccctaaaaccggggg

SEQ ID NO: 311756 - DNA, 673 bp, Homo sapiens
  misc_feature: GZ8MTXP02JM45C.25.36.D03.1.454.CMB.2.raw
  modified_base (249)..(249): a, c, t, g, unknown or other
  misc_feature (249)..(249): n is a, c, g, or t
  modified_base (331)..(331): a, c, t, g, unknown or other
  misc_feature (331)..(331): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcgtcaccatcctctgcacgtacggaaccagccgtagactagttgggtntacttaataactatcgtcctccgtacggtaccccaaacaacccacccgaggaccaaaccggacccccaaactcatctattangtatgtcagtcacgtcccgtcctgtaggtacgtttcccgtcggtctcttctcgtcggtcctccgtagttccgtacggacctaccgtcccggtccctcccgtacgaccctcgttcccggtccggggtcctcccgaggtccgtacgggacggacgacggtaccttaactttagttattacgtacttactttcaaatacgacgaacgaacctaaccaagttacgtacgttgggttacggttcggggaccgggtaacggggtaacccttaacgggtaccgtacccggttccgtacggtaaccgaccggtacccgacggtcccgtcccgtcccccggtacggtaccc

SEQ ID NO: 311757 - DNA, 521 bp, Homo sapiens
  misc_feature: GZ8MTXP02JNHC0.25.36.D03.1.454.CMB.2.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (321)..(321): a, c, t, g, unknown or other
  misc_feature (321)..(321): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgacattggncttataactatgtctctggtcccaacaacaccagcaaggcccccaaactcatcatttatgatgtcagtcatcggccctntggtagtttcctggtcgtcttctcgtggctccaagtctggcaactcggcctccctgacccatccgcggggctcccgagcctgaggacgaggcttacttattatgctatttcatacagagacacaacagtctggtcgtcggcggacggactaaggttcgaccgtccttcggaacacgacccaggcctcgccccctggtccc

SEQ ID NO: 311758 - DNA, 611 bp, Homo sapiens
  misc_feature: GZ8MTXP02F0GNE.25.36.D03.1.454.CMB.2.raw
  modified_base (194)..(194): a, c, t, g, unknown or other
  misc_feature (194)..(194): n is a, c, g, or t
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (328)..(328): a, c, t, g, unknown or other
  misc_feature (328)..(328): n is a, c, g, or t
  modified_base (360)..(360): a, c, t, g, unknown or other
  misc_feature (360)..(360): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactccnggacagtcggtcaccatctcctgcactggaaccngccgtgacattggtncttataactatgtctcctggtccaacaacacccaggaccaacggacccccaaatcatctatttatgatgtcagtcatccggcctntggtagttcctggtcgcttctctgctcagtcnggcaacgtcgcctccctcgaccactcgtcgggctcccgaggcctaggacggacgacgtcttaacttattacgttgcctatttaccaattaaccgaggtacacctaaccaacgtagtcgtacggtcggttaccgggcgggtaacgggtaaccgtaacggttaccggtaacccggttacccgtccgggtaacgtacccggaccccgttaaacgggcccccgtacccggtaccccccggtacgggtttaccccg

SEQ ID NO: 311759 - DNA, 528 bp, Homo sapiens
  misc_feature: GZ8MTXP02I5ID2.25.36.D03.1.454.CMB.2.raw
  modified_base (207)..(207): a, c, t, g, unknown or other
  misc_feature (207)..(207): n is a, c, g, or t
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagagggtctccatctcttgttctgggagcagctccgacgtcggaaataagttgtctactggtaccagcagctccagaacggccccaagctcctnatctataggaatgatcagcgcctcaggataccngaccgattcnctggctcgaagtctggctccgtcgccctcccgtggcccatccagtgggcctcggtccgaggatggaggctgaacttattactgtgcgtaggtttgggattgcctagtctggtagtcggtccgacgggttgttacgggcggacggggaccaagtccgtggaccgtccgtaggtcacgcccgaagg

SEQ ID NO: 311760 - DNA, 571 bp, Homo sapiens
  misc_feature: GZ8MTXP02JKRST.25.36.D03.1.454.CMB.2.raw
  modified_base (309)..(309): a, c, t, g, unknown or other
  misc_feature (309)..(309): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (486)..(486): a, c, t, g, unknown or other
  misc_feature (486)..(486): n is a, c, g, or t
  modified_base (535)..(535): a, c, t, g, unknown or other
  misc_feature (535)..(535): n is a, c, g, or t
tcagactgtacagtcacgaccggtgctcgatttagctgcgtcacgatctctcttggggctgggagacgagcccagcactggaagtcgccggtgttgccattcggtgatcagcactgaacacagaggactcaccatggagtttgggctgagctgggttttcctcgttgctctttaagaggtgtccagtgtcaggtgcagctggtgcagtcgtgggggagcgtggtccaccgtggggacgtccctgagactctctgtgcagcctctggattcatctcaactacctatcgcaatcgacacgtcggggtcccncgaggcctccgagggaccgaaggggctgggagtggggtcgctagttnttcatgngatagaataaataaaagtntgttnacgtcggtgggcggtacccattccgaccgtctaccgagagacagtactaccgaaaggagacggttagaactaccgtacaaacgtaccaaacaaccgtanaacgacgtaccggaggaaccgaccggtgtacgtagttaactcggtaggnggacggacgtacggccggtcgggaccggtacgtcgg

SEQ ID NO: 311761 - DNA, 611 bp, Homo sapiens
  misc_feature: GZ8MTXP02IQAY6.25.36.D03.1.454.CMB.2.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (302)..(302): a, c, t, g, unknown or other
  misc_feature (302)..(302): n is a, c, g, or t
  modified_base (348)..(348): a, c, t, g, unknown or other
  misc_feature (348)..(348): n is a, c, g, or t
tcagactgtacagtcacgaccggtgctcgatttagctgcgtcacgatctctcttggggagcttcagctgtggtagagaagacaggattcaggacaatctccagcatggccggcctccctctccctcctcaccctcctcactcactgtgcagggtcctgggcccagtctgtgctgactcagccaccctcagtgtctgggacccccggcagaggtctccatctnttgtctgggancagctccgacgtcggaaatagttgtctactggtaccagcacgctcccagaaaccggccccaagcctccncatctataggaatgatcagcgcctgacggatacctgaccgattccnctggctcggtaacgtcgtggcctccgtccggccctcccgtcggcccatccgaggttcggccgttccgggtccggaggacgtggaaggctagaacttattacgtgtgtcgtaggtttgggatcgaccgtaggtcgtaggtaggtacgggtaccgggtacggggtttcgggttaccgggggacgggtacggggaacccgtaaacgggccgttaaccggaccccggttacccgtaacgggtccgaaccggacccccgaacccgggg

SEQ ID NO: 311762 - DNA, 624 bp, Homo sapiens
  misc_feature: GZ8MTXP02I4SDF.25.36.D03.1.454.CMB.2.raw
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (368)..(368): a, c, t, g, unknown or other
  misc_feature (368)..(368): n is a, c, g, or t
  modified_base (493)..(493): a, c, t, g, unknown or other
  misc_feature (493)..(493): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagaggtctccatctcttgttctggancacgctccgacgtacggaaattagttgtctactggtaccagcacgcctacccgaagaacccggcccccaagtcctcctcatctaagtaggaatgatcgacgccggccctgacgggtataccctgaccgtattccncgtcggcctacggaacgttcgtggtcccttcccgtccggacccttccccgtaggccctagtccgtacgggtcgggcccttacccggggtccgagggactgggacggcttaggaacttattccggngtacgtacgttagggttggacgtcgtaccgtagttcgtaggtacgggtcggtaccggtacgggttcgggtacgggacgggacggaccgaggtccgtacggtaccgtacggtacggtccgacggaccgtacg

SEQ ID NO: 311763 - DNA, 630 bp, Homo sapiens
  misc_feature: GZ8MTXP02GN8HQ.25.36.D03.1.454.CMB.2.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
tcagactgtacagtcacgaccggtgctcgatttagctgcgtcacgatcgtcgtcttggggagcttcagctgtggtagagaagacaggattcaggacaatctccagcatggccggcctccctctcctcctcaccctcctcactcactgtgcagggtcctgggcccagtctgtgctgactcagccaccctnagtgtcgtcggggacccccgggnaggagggtcctccgatctcttgttcngggancagctccgacgtcggaaatagttgtctactggtaccagcacgcctcccgaagaaaccggcccccaagcctccgcatctagtaggaatgatcagccggcctgacgggactacctgaccgtattctcgtcgggcctacgaacgtcgtcgggccttcccgtccggtccctcccgtggcccacgtcaacggttcgggcccttaccgggtcccgagggtatacggaacgtcgtaaggtaaacttagttaaccgtggtacgtacgttaagggtttggaacttcggacccgtagtccgtggtaacggttcgggtacccggtacgggttggtcgggacgggacggaccaaggtccgtacggacccgttacgtaggtaccgacggacccgaacggg

SEQ ID NO: 311764 - DNA, 656 bp, Homo sapiens
  misc_feature: GZ8MTXP02G6LW3.25.36.D03.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (417)..(417): a, c, t, g, unknown or other
  misc_feature (417)..(417): n is a, c, g, or t
  modified_base (492)..(492): a, c, t, g, unknown or other
  misc_feature (492)..(492): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggacccccggnaggagggtctccatctcttgtctgggancagctccgacgtacggaataagttgtctactggtaccagcagcctaccaacgaaccgcccccaaagcctctacatgtagtggaatgatcacgccgcccctgaccggggtccctgaccgtattctctcgccctccgacgtcctcgccacctcacgtccctcccgtcggacctacgtcccggngggtcccctaccgaacgttccgtagaacggtcgttaggaccggttaccgtaattttaagttacgttgggttaacnccggtacggtcggttaggggattacgggaacgaaagggtaaaccggttaaaggttacgttaggttaccggttaacggaaggtttaccgggaaaccgtaacggttaccgtaacccggttacgtacgggtaccaccggaccccgtaaacggaccccctaaaccccg

SEQ ID NO: 311765 - DNA, 620 bp, Homo sapiens
  misc_feature: GZ8MTXP02IKZFC.25.36.D03.1.454.CMB.2.raw
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttatactggagctggattcgccagtccgccgggagggactggagtggattgggctatatatacgaatgattaaccacctacaaccctctnaagagtcatcacatancagcgacacgtcaggntcagtntccngcatctgacttngcgactgccgacggacaccggccctaatactacgtgtcgccaagacgtacgtttccgggactgacgacgttagttttacggagtaaatttatttaattcgtttagttgttcttttgactagttggtacggggtaccgtaaggggtacgtacgggttaccgtaacccggtcttaccgttacgacgtcccgtaccacccgaaacgggccctaacgttccgttcccgttcccccgtcggacccctaccccgtaccctaccgaaaccgtaacgacccgaacccgttcggtacgggggaccaaccggacggtcccgg

SEQ ID NO: 311766 - DNA, 740 bp, Homo sapiens
  misc_feature: GZ8MTXP02GR2VS.25.36.D03.1.454.CMB.2.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (426)..(426): a, c, t, g, unknown or other
  misc_feature (426)..(426): n is a, c, g, or t
  modified_base (452)..(452): a, c, t, g, unknown or other
  misc_feature (452)..(452): n is a, c, g, or t
tcagactgtacagtcacgaccggtgctcgatttagctgcgtcacgatcgtcgtcgttggggagcttcagctgtggtagagaagacaggattcaggacaatctccagcatggccggcctccctctcctcctcaccctcctcactcactgtgcagggtcctgggcccagtctgtgctgactcagcccaccctnagtgtccgtcggggaccccggnaggacgggtctccgatctcttgttctgggancagcctccggacgtacggaaatagttgtctacgtggtaaccagccagtccctacccgaacggaaaaccccggccccccaaaggccctaccgtacgaacgtacgtaaggtaagggaaaacttggaacttcaaacgggccggacccctaggaacggggtaactacccgtagaaccgttattccncgttgggaccttacggaaagttccgngggtccctcccgtccggtcccctcccgtacggaccctaaacgtccaaaggggttccggcccgtttacccggggtaccggtaagggacgttggaaacgggtctaaggtaaacttaacgttaccgtaggtgtacgttagggtttagggaacgttcggacccgtaagttccgtagggtaaggttccgggtacccggtagggggttcggttaccgggaccggggtaaacggaccgaaacggtcgtaaccgggtacccgtacggtacggtacccgaacggacccgtaaccggg

SEQ ID NO: 311767 - DNA, 641 bp, Homo sapiens
  misc_feature: GZ8MTXP02FXXC3.25.36.D03.1.454.CMB.2.raw
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactccgtggacagtcgtcaccatctcctgcacgtggaaccagccgtgactagttggtntcttaataactatgtctctgtccaacacaccagcaacgccccaatcatctattangatgtcagtcagtccgcctgtggtactttccgtggtcgtcttctcgtcggctcgaagtctggacctacgtccggtcctccctagacctacgtcgtcgggctccgagtcgtaggacgggacgtacgtcttaacgtttagttagttcgacttactttacaattaaccgaggtaacgaacctaaaccgtaaacgtacgttcggttacgggttacggttaccggggacgggtaaaccgggtaaccgtaaacgggtttccggaacccggttcccgttaccgggtaaccgtaaccggaacccgtaacgggtccccgtaccggtccccccggttacggtaaccccg

SEQ ID NO: 311768 - DNA, 590 bp, Homo sapiens
  misc_feature: GZ8MTXP02IJAEF.25.36.D03.1.454.CMB.2.raw
  modified_base (306)..(306): a, c, t, g, unknown or other
  misc_feature (306)..(306): n is a, c, g, or t
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccggccgggagggactggagtggagttgggcgtatatatacgaatggattaaccacctacaacccctcctacaagagtcgagtcaccatactcagcgacacgtcagggatcaggtntcctgcatctgacttntgcactcgccgccggacaccggtccctatactactgtcnccgaanagtattccggaatcgacgaacgtagtttttacggaagtaattattaattctttagtgtctttgactagtggtgggacgaagggtacgaacgggtcaaccgtcttcttacgacgtcctaccgaaccgaaacgggccctaacgtccggttcccttcccccgtggtccctacccctccctaacccaaacgcgacccaccgttccgcggggccaaccgacggcccgg

SEQ ID NO: 311769 - DNA, 589 bp, Homo sapiens
  misc_feature: GZ8MTXP02GV2AZ.25.36.D03.1.454.CMB.2.raw
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgcagtccgccgggagggactggagtggattgggcgtatatatacgaatggattaaccactacaccctcctnaagngtcgagtcaccatatcagcggacacgtccagggntcaggtntcctgcatctgacttntgcgtactgccgccggacaccggccctatactacngtgccagagtacttcgggactgaccgtacgtagttttacggaagtaattattattactttgtgttactttgactagtggtcgggtaccgaagggacgtacggtacacgtccgtcttcgacgtaccctccaaccgaacgggccctacgtccggttacccttcccccgtcggaccctaccccgtccctaccgaaacgcgtaccgacccgttcggtacgggggaccaccgtacggccccgg

SEQ ID NO: 311770 - DNA, 560 bp, Homo sapiens
  misc_feature: GZ8MTXP02FXMVD.25.36.D03.1.454.CMB.2.raw
  modified_base (250)..(250): a, c, t, g, unknown or other
  misc_feature (250)..(250): n is a, c, g, or t
  modified_base (366)..(366): a, c, t, g, unknown or other
  misc_feature (366)..(366): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (445)..(445): a, c, t, g, unknown or other
  misc_feature (445)..(445): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggttttcctgttgttattttccaggtgtccagagtgaggtgcagttggtggagtcgtgggggagcttggtccagccgtggggggtcctgagngtctcctgtgcagcctctggattcatcttcagtgaccactacatggactgggtccgcaggctcgaggggagggctggagtgggtggcgtatagaaataagctaagagttacaccanagaatacgcgcgtctgtagaaaggcagtattcattanctanaagagatgaattacaaagaactcaactagtatccgtanaacaaatacgaacacgaccgtaaacggaaaaccggacggaaccgacgggtaccgttagttaacgtacgtgtacgtaacgtacggtactacgtaccgtacggtacgtaacctaacc

SEQ ID NO: 311771 - DNA, 659 bp, Homo sapiens
  misc_feature: GZ8MTXP02HKDQO.25.36.D03.1.454.CMB.2.raw
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctctgcactggaaccagaagtgatcttggtgcttatgacactgtctcctggccacctacgtttaccccgaaggaaaccgcccccagacgtcacttcctttatgatgtcaggaacgccgcctcgaccgggtcctgactcgtcttctcgtcgggtaccaaatcgtacgaccaaccgaccggtccctcccgtacgaccctactccgtcgtcgggccttccggaacggtccgtagggaggtacgtaggaacggtctaggttaatttatttagttcgtacgtttggttactaattagttacgacgtaaaggtaccctaaaacgttaccgtttaaggtttttcggggtcggtttaccgggaccggtaccggtaaccggggtaaaccgttaaaggtttccggtaacccggttccggtacgggttacccgaccgggtaaccccgtaaacccgggg

SEQ ID NO: 311772 - DNA, 562 bp, Homo sapiens
  misc_feature: GZ8MTXP02FQ7G7.25.36.D03.1.454.CMB.2.raw
  modified_base (210)..(210): a, c, t, g, unknown or other
  misc_feature (210)..(210): n is a, c, g, or t
  modified_base (302)..(302): a, c, t, g, unknown or other
  misc_feature (302)..(302): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (429)..(429): a, c, t, g, unknown or other
  misc_feature (429)..(429): n is a, c, g, or t
  modified_base (454)..(454): a, c, t, g, unknown or other
  misc_feature (454)..(454): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagcccaccctcagtgtcgtcggggcccccggnaggagggtcgacatctcttgttctggagtcgctccaacgtcggcagtaatagtgtaagctggtaccagcaactcccgaggaaccgcccccanactcctcatgtatgggaatgactcagccgcccctcgacggggtccctgaccctnttccnctcgccctcacgtctgcacctcacgccctccctggccagtcccggtcggcctaccaatctagaggtanggacgccgttattattagtttgacncgagcggtgggatcggaacgaaggaaacggtacggttagtcgtcgttacggaagttacggacgtaacggtcgtaccgtacgtacggcaacgcccgaaacggtaccccc

SEQ ID NO: 311773 - DNA, 738 bp, Homo sapiens
  misc_feature: GZ8MTXP02GJ474.25.36.D03.1.454.CMB.2.raw
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (271)..(271): a, c, t, g, unknown or other
  misc_feature (271)..(271): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtgctgactcagccaccctcagtgtctcgggacccccgggnaggacgggtctccatctcttgttctgggancagctccgacgtcgaatagttgtctatgtacngcacgctcccacgaaaccgcccccaagcctcctcatctataaggatgatcagccggaccctcgaggactacctcgaccgtacttctcgtcgggtctacggaagttccgtcggcccttcccgtcccgggtcccccgttccccgttcgggccctaacgtccgtaacggggtccgggggtcccggttcccggggtaccccggtaacggggtagttaccggggtacgggtaccgttaaggtaaaagtttacgtttaaaccgttggggttcgtaccggttaagggtttttggggaacgttcgggtaacccttacgggttgtttacggggtaaccgggtttcgggggttaaacccgggtacgggggtttacgggtttccgggggaacgggggtaccggggaaaccggttaacggccggttacggtaaccccggttacgtttaacggtccgaacgggtaccccgtaaaccgggg

SEQ ID NO: 311774 - DNA, 566 bp, Homo sapiens
  misc_feature: GZ8MTXP02JMMAE.25.36.D03.1.454.CMB.2.raw
  modified_base (306)..(306): a, c, t, g, unknown or other
  misc_feature (306)..(306): n is a, c, g, or t
  modified_base (371)..(371): a, c, t, g, unknown or other
  misc_feature (371)..(371): n is a, c, g, or t
  modified_base (414)..(414): a, c, t, g, unknown or other
  misc_feature (414)..(414): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggtttcctgttgttattttccaggtgtccagagtgaggtgcagttggtggagtcgtgggggagcttggtccagccgtgggagggtccgtgagagtctcctgtgcagcctctggattcatcttcagtgaccatacatggactgggtccncaggcctccgaggggagggctgggagtgggtgcccgtatagaaataagctaaagactacaccaanagaactacgcgcgtcagtagaaaggcaagattcaattcactanaagatatagattacgaaaagactcatagtatctagactaaatcgaacacgacctaacggaaaaccgaggaaccgtacgggccgttaggtaactttacgtaggtaacgtacggttacgggtaccaaggtaccgtaacgggttactaaaccccg

SEQ ID NO: 311775 - DNA, 712 bp, Homo sapiens
  misc_feature: GZ8MTXP02JO213.25.36.D03.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggacccccggnaggaggtctccatctcttgttctgggancagctccgacgtacggaaattagttgctacgtggtaccagcagctcccagaaccggccccaagcctcctcatctataggatgatcgagccggccctgacgggactaccgtcgaaccgtattcctcgtcgggccttacggaacgttccgtcggggtccttccccgtccgggtccccttacccgtcggaccctacgtccgtaggggttccgggtcccgtaccccggggttccggaagggtacgttcgggacgggtccttaaggaaactttacgtttaccgtgggttacgtacggttaaggggtttcggggaacttcggacccgttaaggttccgtagggtacgggtttccggggtacccgggtacggggtttcgggttccggggaccggggtaacggggaacccgtaagggtccggttaccgggtaccccggttaccggttaacggggtccctacccggggtaccccgtaaaccgggg

SEQ ID NO: 311776 - DNA, 519 bp, Homo sapiens
  misc_feature: GZ8MTXP02HAXSS.25.36.D03.1.454.CMB.2.raw
  modified_base (331)..(331): a, c, t, g, unknown or other
  misc_feature (331)..(331): n is a, c, g, or t
  modified_base (378)..(378): a, c, t, g, unknown or other
  misc_feature (378)..(378): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctggtgcgacaggcccctggacaagggctgagtggatggcatggatcagtcctaaacntcgtatcacagactatgcacgagattccgaggcagatcactgaccanagacacactcacgagacacagcctaacagtggacctgaaggacgccgtagagactcgtagacgaacgacggaccgtataacgttacgtgtacgacgaggagtcggaatttacgagtaccgttacgtccgggtactacccgg

SEQ ID NO: 311777 - DNA, 729 bp, Homo sapiens
  misc_feature: GZ8MTXP02HYPWB.25.36.D03.1.454.CMB.2.raw
  modified_base (266)..(266): a, c, t, g, unknown or other
  misc_feature (266)..(266): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtgctccgtcagtgcttattactggagctggactccggccaggtccggccggggaggggactgggagtggattgggctatatatacgaatggattaaccacctaccaacccctcctanaagatcgagtcaccatatcagccggacacgtccgagggactcgaggttcgttcctgctatctagtactttcgtacggccgtaacgtcggcccggcccggaccacccgggtcccctaagtacccttacgtgtcggaccaaggagtacgtttacgggactggacccgtacgttaactttttaccggaagttaaatttaactttaatttcgtttggttcgttcgtttttagacgttagttagggttcgggggaacccgtaaagggggtaaccgtaccggttaccggtacccggttccttcgttaccgtacgcccttacccgaaccggaaaaccgggtccctaacgtttcccgggttacccccttcccccgttcgggcccctacccccgtttccctaaccccgaaaacggtaaccggaccctacccgtccgggttcgggggtacccaccgtaaccgggtccccgggg

SEQ ID NO: 311778 - DNA, 589 bp, Homo sapiens
  misc_feature: GZ8MTXP02FJIGF.25.36.D03.1.454.CMB.2.raw
  modified_base (236)..(236): a, c, t, g, unknown or other
  misc_feature (236)..(236): n is a, c, g, or t
  modified_base (340)..(340): a, c, t, g, unknown or other
  misc_feature (340)..(340): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggancagctccgacgtacggaaataagttgtctactggtaccagcagctccagaaaccgccccaagctcctcatctataggaatgatcagcgccctcgaggactaccngaccgattcctcgtcgctcgaagtctggctccgtcggccctccctcggccattcgaggtcgggcctccgggtccgaggtatggaggctaggaattagttacgtggtcgtacgtaggttttaggggattcgaccgtagttcgtaggtacggttcgggtcccggtacggggttggttccggggacggggtaacggggacccgaaaggtccgtacggtacccggtcctaacgggtccacggccccgaaacgg

SEQ ID NO: 311779 - DNA, 551 bp, Homo sapiens
  misc_feature: GZ8MTXP02F9PYB.25.36.D03.1.454.CMB.2.raw
  modified_base (301)..(301): a, c, t, g, unknown or other
  misc_feature (301)..(301): n is a, c, g, or t
  modified_base (484)..(484): a, c, t, g, unknown or other
  misc_feature (484)..(484): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaagccccaaatcatcatttangatgtcagtcacgtcgcctgtggtactttccgtgttccgtctttctctcggtcctccaagtcgtggacctaaccgttccggcccttcccctagaccctacgtccgtccggggaccttccgacggcgtaggacggacgacgtcttaactttattattcgactatttacaatacagagacacaangtctggtcgtcggcggtacggactagtcgaccgtcgtacgtcacgaccgacgcctcgtccctcgtcc

SEQ ID NO: 311780 - DNA, 668 bp, Homo sapiens
  misc_feature: GZ8MTXP02JSD3R.25.36.D03.1.454.CMB.2.raw
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtgctccgtcagtgcttattactggagctggatccgccagtccgcgggagggactggagtggattgggctatatatacgaatggattaaccacctacaacccctcctcaagagtcgagtcaccatatcagcggacacgtccagggactcgaggtcgttcctgcatctgacttctgcgactcggccgccggacaccgggccctaatacctactgtcgccaggacgtagttcggactgaccgtacgtagtttttacggagtaattattattctttgttgttcttttagactagttggtacggggtaccgaaggggtaccgtacgggttaccgtaacccggttccttccgtttaccgacggtccccttacccgaacccgaaaacggggtccccctaacggtccccggttacccgtttaccccccgtccgggttacccctacccccgttaccccttacccgaaacggtaaccgacccgtaacccggtccgggttcgggggacccaaccggacggtcccccgggg

SEQ ID NO: 311781 - DNA, 795 bp, Homo sapiens
  misc_feature: GZ8MTXP02JKFH2.25.36.D03.1.454.CMB.2.raw
  modified_base (214)..(214): a, c, t, g, unknown or other
  misc_feature (214)..(214): n is a, c, g, or t
  modified_base (246)..(246): a, c, t, g, unknown or other
  misc_feature (246)..(246): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtcgtcgtccggggacccccgggnaggagggtcctccattctcttgttcgtgggancagctccgacgtacggaaatagttgtctacgtggtaccagcacgcctacccgaacggaaacccggcccccaaagtccctcctactaactacctaaagtaacgggaaaattcggaacttccgaaacggtccccggtacccctacggaaacggggtaccttaacccggtcgaaaccccggttatttcccgttccgtcgggggtacctttacgggaaaccgtttccgtccggggtccccctttccccggtccccgggtaccccgttcccccgtcggtacccctacggttccggaccggggttcggggtcccccgtcccgggggtaacccggagggtacgttacggggacggtaccgttaaggtaaactttaacgtttaccggtaggttccgtacgtttacggggttaggggtactcggcccgttaagtcgtacgggtacggttcggggttaccgggtacgggtttcggggtaccggggacggggaaacggtaccgtaacggcgttaccggtaacccggttacggtacgtaccgacccggaccgtaacccggg

SEQ ID NO: 311782 - DNA, 609 bp, Homo sapiens
  misc_feature: GZ8MTXP02GT5MD.25.36.D03.1.454.CMB.2.raw
  modified_base (189)..(189): a, c, t, g, unknown or other
  misc_feature (189)..(189): n is a, c, g, or t
  modified_base (209)..(209): a, c, t, g, unknown or other
  misc_feature (209)..(209): n is a, c, g, or t
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtgctgactcacgccaccctnagtgtcgtcgggaccccggnagaggtctcatctcttgttcgnggancagctccgacgtacggaaattagttgtctacgtgtacccagcacgcctacccgaacgaaccggcccccaagtcctcctcatctaatacggatgatcgacgccgcctacgacggtactaccgtagaccgtacttcctcgtcggtcctacggtaacgttccgtcggtcctcccggtcccgtcccctccgtcggtaccacgtcgcggtcgggcccgttacgggccggagacgtgacggctaggtattagtctggtcgcgttagggttcggattcgaccgtgtcgtggtacggtccgggtacggtcgggttcggttcgggacgggacggtacaacggtcgtaccggtaccgtacggtcgaccgaccgtaccgtaccgg

SEQ ID NO: 311783 - DNA, 581 bp, Homo sapiens
  misc_feature: GZ8MTXP02IFEBN.25.36.D03.1.454.CMB.2.raw
  modified_base (209)..(209): a, c, t, g, unknown or other
  misc_feature (209)..(209): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggttttccttgttgttatttttccaggtgtccagagtgaggtgcagttggnggagtcgtgggggagcttggtccagcctgggaggtccgtgagngtctctgtgcagcctntggatcatcttcagtgaccactacagtggactggggtcccgcaggcctccgaggggagggctggagtgggtgccgtatagaaataagctaaagngttacaccanagaataccgcgntcngtagaaaggcagattcaattatctagaaagagatgtaaattacaaaagtaactacctatagttaactatagaactaaagtagaaacgaacgtaaccgaaaacggaaaaaccggacggaaaccgaaccgggtacgttacgttaacgttacgtggtaacgtacgtacggtacgaacgtacgtaacggtactaaccg

SEQ ID NO: 311784 - DNA, 559 bp, Homo sapiens
  misc_feature: GZ8MTXP02F89QN.25.36.D03.1.454.CMB.2.raw
  modified_base (247)..(247): a, c, t, g, unknown or other
  misc_feature (247)..(247): n is a, c, g, or t
  modified_base (324)..(324): a, c, t, g, unknown or other
  misc_feature (324)..(324): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagcccgtgactattgggtntctttaataactattgtcctcctggtccccaaacaaccaccccaggaccaacggccccccaaaatcatccatttacngatgtcagtcaatccggcctntggtatttccnggtcncttctctcggctccaagtctggcacgtcggcctccctgacctatcgtcggggctccgaggctggacggacgagcttaacttattattcgtctatttacataaccgngaanacaaccagacgtctaggtcgttcgggcggaggtaccaggttccgaccgtccgttacggcacgacctacggcctccgcccgtcggtacc

SEQ ID NO: 311785 - DNA, 617 bp, Homo sapiens
  misc_feature: GZ8MTXP02GLOD8.25.36.D03.1.454.CMB.2.raw
  modified_base (208)..(208): a, c, t, g, unknown or other
  misc_feature (208)..(208): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
  modified_base (388)..(388): a, c, t, g, unknown or other
  misc_feature (388)..(388): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagccacctcagtgtcgtcggggcccccggnaggagggtcgacatctcttgtctggatcgctcaacgtcggcagtaatgtgtaagctggtaccagcaactccaggaaccgccccanactccncatgtatgggaatgatcagccnccctcgacgggtccctgacctatctctcgcctcacgttcncgcacctcacgccctccctcggacccncgtccggtcggacctaccgaactcgtagacggtagtacgggaacggtaccgttaatttaacgtttagttcggtacgacggtagggtcgggtagggtacgtaacggaacgaaagggtaaaacggttaaacggtttagtacggttaccggttaacggtaacggttacgggaaccgtaacggtaacccgtaaccggttacgtacggtaccgaccggacccgaaccgaccccg

SEQ ID NO: 311786 - DNA, 636 bp, Homo sapiens
  misc_feature: GZ8MTXP02GBVBD.25.36.D03.1.454.CMB.2.raw
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
  modified_base (524)..(524): a, c, t, g, unknown or other
  misc_feature (524)..(524): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcaggtgacaggatggggaccaagagaggggccctgggaagcccagtggggccctgctttctcctcttgtcttccttttgtctcttgtctatcgccatgtctgtgtctttctcacttccgaggtcctgggcccagtctgtgctgactcgagtgtcgtcggggacccccggnaggacgggtcctccgtattcctcgttgttacgtggggacnccaggcctaccggaacgttacgggtaaattagtttcgtacgtacgtcgggtaaccagcacgtcctacccgaacgaaacccggcccccaagcctaccctcaacttcgtaattaggaaacttggacttcgacggcccgacccgtagaacgggtactaccgtgaaccgtnttccgtcgtggtcctacggtacgttccgtcgggtccttcccggtccggtcccttacccgcgggtacccctaagtccggtaacggtccggggtcccgtcccggggttaccggg

SEQ ID NO: 311787 - DNA, 613 bp, Homo sapiens
  misc_feature: GZ8MTXP02GXNN3.25.36.D03.1.454.CMB.2.raw
  modified_base (208)..(208): a, c, t, g, unknown or other
  misc_feature (208)..(208): n is a, c, g, or t
  modified_base (310)..(310): a, c, t, g, unknown or other
  misc_feature (310)..(310): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnagagggtcctccatctcttgttctgggagcagctccgacgtcggaaattagttgtctacgtggtaccagcacgctacccagaaaccggcccccaagcctccncatctagtaggatgatcacgccgcctcgaacggactaccgtcgaccgtattccgtctcgggacttcggtaagtccgtcgggtcctccgtccgggtccctcccgtcggaccatcgagtcggggcctcgggtccgaggtactggaaggccgttaagaattacgttaactgggtagtcgttaaggttttgggactggtccctaggttcgtaggtacggtcgggtaccggtcgggttcggttacgggcgggaacgggaccctaagccgttacggacccgtcggtacggtacacggtacccgtaacgg

SEQ ID NO: 311788 - DNA, 641 bp, Homo sapiens
  misc_feature: GZ8MTXP02H8B0U.25.36.D03.1.454.CMB.2.raw
  modified_base (245)..(245): a, c, t, g, unknown or other
  misc_feature (245)..(245): n is a, c, g, or t
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (363)..(363): a, c, t, g, unknown or other
  misc_feature (363)..(363): n is a, c, g, or t
tcagactgtacagtcacgaccggtgctcgatttagctgcgtcacgatctctcttggggacccaaaaaccacacccctccttgggagaatccctagatcacagctcctcaccatggactggacctggagcattcttttcttggtggcagcagcaacaggtgcccactcccaggttcaactggtgcagtctggacctggaggtgaagaagccgtggggcctcgagtgaaggtctcctgcaaggcttntggttacactttagcagctatggcatcagcgtggtcgcgacacggcccctggacgaagggtcttgaggtggatggcagtggatnacgtaccttaacngtacggtatcgacagacttancgcaacgaggtaactttaccgagggaccgagacgtcctaaccgttacggaacccaacgaacgaactaacacacccgaacgacgaccaaacgacgtcctaaaccgagttacggacccgtagggacggaaacgcccgtagacgtacgttaccgtacggaacccggaacgaaccgggtaccgtttaaggttaaactttccgttaacggtaggaccggtaggtacggtaacggtaatttaacgtcggttaccgtttaaccgtccgggtttacgtaaccccgg

SEQ ID NO: 311789 - DNA, 623 bp, Homo sapiens
  misc_feature: GZ8MTXP02IZEVI.25.36.D03.1.454.CMB.2.raw
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (308)..(308): a, c, t, g, unknown or other
  misc_feature (308)..(308): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttatactggagctggactccgcagtccggcggggagggactggagtggattgggctatatanacgaatggaacttaaccacctacaacccctcctanaagngtcgagtcaccatactcagcggacacgtccagggatcgaggtntcctgcatctgactttcngcgactgccgngaccacggccctaatacctactgngccagagtacttcgggactgacgacgtagttttacggagtaattattattcgtttgttgttcttttagactagttggtacgggggtaccctaaagggggaccgtaccgggtacgtaacccggtcttccgttacacggtcccttaccaaccgaaacggggtcccctaacgtcccggttcccgttcccccgttcggcccctacccctacccgtaccgaaacgcgacctaacccgttcggcggggaccaccggacggtccccggg

SEQ ID NO: 311790 - DNA, 764 bp, Homo sapiens
  misc_feature: GZ8MTXP02IOW66.25.36.D03.1.454.CMB.2.raw
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (312)..(312): a, c, t, g, unknown or other
  misc_feature (312)..(312): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtagactagttggtntcttaataactatgtctcctcgtacccaacaaccacccaggcaacgaccccaaactcatcatttangatgtcagtcactccggccctgtggtacgtttccgtcggttccgtctttctcgttcggtccttccgtaaacgttccgtacgggtacctaaaccgtccgggtccccttccccgtacgaccctacgttcccgtccgggggccttacccggtacggtccgtacgggaacgggaaccggacggtacctttaaactttacgtttaagttcggttacttattttaccgaacttaaccgaacgtaaacgtaaacccaaacccgtaaaacgtaaccggtttcggttaacgggttcgggtttacccgggggaacgggggtaaaccggggtaaacccgttaaacgggttaccgggtaacccccggtttcccggtttaccgggtaacccggtaaaccggacccccggtaaaaccgggtcccgttacccccgggtacccccccggtttacggggtttacccccg

SEQ ID NO: 311791 - DNA, 542 bp, Homo sapiens
  misc_feature: GZ8MTXP02FJHI1.25.36.D03.1.454.CMB.2.raw
  modified_base (210)..(210): a, c, t, g, unknown or other
  misc_feature (210)..(210): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (476)..(476): a, c, t, g, unknown or other
  misc_feature (476)..(476): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtccgtgggcccagtctgtgctgactcagccaccctcagtgtctcgggacccccgggnagagggtctccatctcttgttctgggagcagctccgacgtacggaaataagtttgtctactgggtaccagcagctcccaagaaaccggcccccaagcctcctcatctataggaatgatcagcggcccctnacgggactacctgaccctattcnctggcctagaacgtctggtcctccgtccggccctcccgtggcccatcgagtcgggcctccggtcgaggatggagctagaatattactgtgctaggtttggatcgcgagttcgngtgtcggtcggtcggtcggtcggacgggacggacagcgtacgtaccgtcgtacggcacgaccgacg

SEQ ID NO: 311792 - DNA, 690 bp, Homo sapiens
  misc_feature: GZ8MTXP02IDX9G.25.36.D03.1.454.CMB.2.raw
  modified_base (247)..(247): a, c, t, g, unknown or other
  misc_feature (247)..(247): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctcgtgtctggactccgtggacaggtcgtcaccatctcctgcacgtggaaccagccgtagactagttggtnacttaataactattgtctccgtacggtacccaaacaaccacccaggaccaaccggaccccccaaatcatactatttactagattgtactagtctagtccggccctcgtggtagtttccctgggttcctctttcttctcggtaccttccgtaagttcgtcggtacctaaccgttcgtcctaccccctcccttacggaaccctacgtccggtccgggggtaccttccgacggtctacgggacggacgtacggtacttaaccgtttatttaactttcgacctttatttaccattaacgtaagaacgaaccgaacctaaacgtacgttaacggttacggttacgggttcgggtacgggtacgggaaccggtaacgttaccggtaacccgtccgtaaccggttacgtacgtacccgaaccggtaccgtccggtacccccgttccccgg

SEQ ID NO: 311793 - DNA, 574 bp, Homo sapiens
  misc_feature: GZ8MTXP02GHS27.25.36.D03.1.454.CMB.2.raw
  modified_base (237)..(237): a, c, t, g, unknown or other
  misc_feature (237)..(237): n is a, c, g, or t
  modified_base (262)..(262): a, c, t, g, unknown or other
  misc_feature (262)..(262): n is a, c, g, or t
  modified_base (327)..(327): a, c, t, g, unknown or other
  misc_feature (327)..(327): n is a, c, g, or t
  modified_base (348)..(348): a, c, t, g, unknown or other
  misc_feature (348)..(348): n is a, c, g, or t
  modified_base (429)..(429): a, c, t, g, unknown or other
  misc_feature (429)..(429): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcaggagggtctccatctcttgttctgggancagcctcgacgtacggaataagttntcactggtaccagcagctccagaaaccggccccaagctcctcatctatagaatgatcagcgcctnagggatacctgaccgtattcnctcggctcgaacgtctggctccgttcggccctacccgtggaccctatgtacggtcgggcctcccgggttaccgagtacggngtacggctagtaattagttcgtggtagtacgttaggttacggacgtcgccgtagtcgtggtacggtcgggtaccggtacggtcggtacggggacggaacggaccacggtcgtacggaccgtcgtacggtaccgacgaccgtaacg

SEQ ID NO: 311794 - DNA, 660 bp, Homo sapiens
  misc_feature: GZ8MTXP02IA5OR.25.36.D03.1.454.CMB.2.raw
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctcagtgtctcggggacccccgggnaggagggtcctccatcttcttgttctgggancagctccgacgtacggaaattagttgctactggtaccagcagcctacccgaacgaaaccggcccccaaagcctcctcatctaagtaggaactgatcagccggtcctgacgggactacctgacccgtatttccgcgttcggccgttacggaaacgtttccgtcgggtccccttcccgtcccgggccccccttcccgcggtccctacgttacgacgggtcgggggtcccttcccggggaccggaggtacgtggacgggtcttaaggtaaactttagtttacgtggtcgtacggttaagggtttgggaactcggtaccgtagttcgaggtagggtacggtacgggtaaccggtttggggtcggggacggacgggtaaccaaggcgttacggaccgtcgacgggtccacggtacccaaccggg

SEQ ID NO: 311795 - DNA, 632 bp, Homo sapiens
  misc_feature: GZ8MTXP02H44KS.25.36.D03.1.454.CMB.2.raw
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
  modified_base (238)..(238): a, c, t, g, unknown or other
  misc_feature (238)..(238): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcggggacccccgggnaggnggtctccatctcttgtcgtggancngctccgacgtacgaaattagttgtactacgtcgtaccagcacgcctaccgaacgaacccggccccaagcctcctacatactaagtaggtaatgactcgacggccgcctacgacggactaccgtacgaccgtacttcgtcgtcggtctacgtacgtcgtcgcctccgtccgccctccgcgcctagtcgtaggtcggtccgtccgggacggaggtacgtaggacggtactaagtaacttagttacgtggtacgtacgttaggttgggactcggaccgtagttcgtacggtacggttccgggtaccgggtacgggttcgggttacggggacggggtaacgggtaaccgacggtcgtaccggtaccgtacggtacggtaccgacggtaacccgtacgg

SEQ ID NO: 311796 - DNA, 630 bp, Homo sapiens
  misc_feature: GZ8MTXP02JSYYL.25.36.D03.1.454.CMB.2.raw
  modified_base (211)..(211): a, c, t, g, unknown or other
  misc_feature (211)..(211): n is a, c, g, or t
  modified_base (244)..(244): a, c, t, g, unknown or other
  misc_feature (244)..(244): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtcgtcgtcggggacccccgggnaggagggtcctccattcttcttgttcgtgggancagctccgacgtacggaaattagtttgctactggtaccagcagcctacccgaacggaaacccggcccccaaagtccctacctacactctaagtaggaatgaactcgaacgccgcctagacgggactaccgtcgaccgtattctcgtcgggcctacgacgttcgtcggtcccttcccgtccggcccttcccgtggaccctagtccgagggtcgggtcccgttcccggggccgaggtacgtcggacggtcgtaagtaacttacgtttcgtggtacgtacgttaggtttcgggattcggaccgtgtcgtggtacggtcgggtacggtcggtcgggtcgggacgggacggtaccaggcgtacggaccgtcgtacggccacggaccgacgg

SEQ ID NO: 311797 - DNA, 538 bp, Homo sapiens
  misc_feature: GZ8MTXP02F73S2.25.36.D03.1.454.CMB.2.raw
  modified_base (304)..(304): a, c, t, g, unknown or other
  misc_feature (304)..(304): n is a, c, g, or t
  modified_base (472)..(472): a, c, t, g, unknown or other
  misc_feature (472)..(472): n is a, c, g, or t
  modified_base (488)..(488): a, c, t, g, unknown or other
  misc_feature (488)..(488): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctgtcccaacaacacccaggccaacggcccccaatcatcatttangatgtcagtcacgtccggccctgtggtacgtttcctggtccgtcttctctcggctccaagtctcggactaaccgtcggccctccctagaccctatccgtccggggcctccgaggcctaggacggacgaggtccttacttagttatgctatttcatacagacacaacanagtcgtggtcgtcggngacggactagtcgaccgtcgcgtcgacgccgtagcctacgcccctggtcc

SEQ ID NO: 311798 - DNA, 505 bp, Homo sapiens
  misc_feature: GZ8MTXP02I6O3Y.25.36.D03.1.454.CMB.2.raw
  modified_base (265)..(265): a, c, t, g, unknown or other
  misc_feature (265)..(265): n is a, c, g, or t
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggagcgtggtccagcctgggaggtccctgagactctctgtgagcctntggatttagttcagtggttctggcatgcacgtgggtcccnccaggcctccgaggcaaggggcccgagtcggtggcagttanagcacatgatgggaattctgaatntangcagactcgngaaggcattcaccatcncagagacagttcccggaatnttgagtactagaaatggtcagcctagagtgtcgaggactcggactctgtacttactgtaagcgagagtcgggagtggtagttacg

SEQ ID NO: 311799 - DNA, 602 bp, Homo sapiens
  misc_feature: GZ8MTXP02I88MQ.25.36.D03.1.454.CMB.2.raw
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (420)..(420): a, c, t, g, unknown or other
  misc_feature (420)..(420): n is a, c, g, or t
tcagactgtacagtcacgaccggtgctcgatttagctgcgtcacgatctctcttggggagcttcagctgtggtagagaagacaggattcaggacaatctccagcatggccagcttccctctcctcctcaccctcctcactcactgtgcagggtcctgggcccagtctgtggtgactcagccaccctnagcgtctcgggacccccggnagacggtcaccctctcttgtctggaancagctaccaatatcggaactaacactgtagaactggtaccagcaggtcccaggaactcggaccccctaaacttctactatttatagtagttatcagccaccctcgacggggtcctcgaccgattctctggcctcgagtctcggccacctcacgcctcccgtgcctatcgaggtcggggtccagtcnggacgatggagtcgtgtacttagttacctgcgtacgagcaaggtgggaatgaactacgtccgtaggtaagttggggttcggtttggggtttaccggggacgggggtaaagggtacggaacggtaaccgttacggacccggtttacccggtaagggtacccgacggtaccccgtaaacccggg

SEQ ID NO: 311800 - DNA, 622 bp, Homo sapiens
  misc_feature: GZ8MTXP02IGECQ.25.36.D03.1.454.CMB.2.raw
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
  modified_base (308)..(308): a, c, t, g, unknown or other
  misc_feature (308)..(308): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcatcccaccctcagtgtcgtcgggacccccggnaggaggtctccatctnttgttctggancagctccgagtcgaaattagttgtctacgtgtaccagcagcctacccgaagaaacccggccccaagcctccnactctagagaatgatcagcgcctgagggactacctgaccgtattcctcgtcgtctacgaagttccgtcgtcctcccgttccggccccttcccgacggtaccctacgttcgacggggttcgggcccgtttacccggggacccgaagggtctacggggaggtcctaagtaaatttaacgttacgttggacgtcgttaggtttggacttcgacctagtccgtagtacggtcggttaccggacgtttgggtaccggacgggacggaacctacggcttaacgggacccgttacgtacggtaccacggtacccgtaacgg

SEQ ID NO: 311801 - DNA, 616 bp, Homo sapiens
  misc_feature: GZ8MTXP02ILCY4.25.36.D03.1.454.CMB.2.raw
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgcttctttttaagaggtgtccactgtcaggtgcacctggtggagtcgtgggggagcgtggtccagcctgggagtccctgagactctctgtgagcctctggtatttagttcagttggttctggcatgcacgtggtccncaggctccgaggcgaaggggccgagtggtgcagttangcantgatggattcagaatntangacagctcgtagaacgggccattcacctatcctaccgagacgaacctaaacgtttccccggaaattagtttggtagttaaccgttaggggaaaattggggtacctaaggtcccttagggaagacggttaccggaagggtacccttcggggtaccttcgttagggttaaaacttttccgtggggttaaggaccggtaagggtacgggttaccgggggtaggggttttacggggttaagttttaaacgggg

SEQ ID NO: 311802 - DNA, 585 bp, Homo sapiens
  misc_feature: GZ8MTXP02JVLC6.25.36.D03.1.454.CMB.2.raw
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
  modified_base (431)..(431): a, c, t, g, unknown or other
  misc_feature (431)..(431): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggcagagggtctccatctcttgttctgggagcagctccgacgtcggaaatagttgtctactggtaccagcagctcccagaaccggccccaagcctccncatctataggatgatcacgcggccctgacggatacctgaccgtnttcctcgtgggcctggaacgtcgtgggcctcccgtccggcccttcccgnggcccagtcgaggtcgggccctccgggtccgaggtntgggagctaggtatacttactggtgcgtagggtttgggatcgacctaggtcgtaggacggttcggggtccggtacgggttcggtacggggacggggtacggggaacccaaggtcgtacgggtacccggtacgtagggtccacggaccgaacggg

SEQ ID NO: 311803 - DNA, 686 bp, Homo sapiens
  misc_feature: GZ8MTXP02GYKMX.25.36.D03.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (362)..(362): a, c, t, g, unknown or other
  misc_feature (362)..(362): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnagagggtctccatctcttgttctgggancagctccgacgtcgaaatagttgtctactggtaccagcagcctaccgaagaaaccggcccccaagcctcctcatctagtagaatgatcagccgccctgacgggtactaccgtagacccgtattccncgttcggcctacggaaagttcctcgggtcctcccgtccggccctcccgtcggcccattccgagggtcggcccgtacccggggtaccggaggagtgggaacgcctaggtaaattattacgtggtggtacgttaagggtttggggaacttcggccccgtaaggtttccgtaaggtacggggttccgggttcccgggtaaccggggttgggtttacccgggggacggggtaaaccgggggaaccctaaaacgggccggtttacccggaaccccggggtttacccgaaaggggttcccgaaacccgggtacccccgtaaacccggggg

SEQ ID NO: 311804 - DNA, 708 bp, Homo sapiens
  misc_feature: GZ8MTXP02JRSU8.25.36.D03.1.454.CMB.2.raw
  modified_base (188)..(188): a, c, t, g, unknown or other
  misc_feature (188)..(188): n is a, c, g, or t
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctnagtgtcgtcggggacccccgggnaggagggtctccattcttcttgttcgtgggncagcctccgacgtacggtaaattagttgtctacgtggtaccagcagcctaccgaacgaacccggcccccaagtccctcctacacttactaagtaagggtaatgaactcgaacgggccccggaccccgtacggaaccggggtaccttaccccgtacggaacccgttactttccgttcgtcggggtaccttaacgggtaacgttccgtcggggtcccttcccgttccgggtccctcccgtcggaccctagtcgtaggttcggtcccgtccgggtaccgagggactgggacgtctagtaattagttacgtgggtagtacgttagggtttgggtactcggacccgtaggttcgtaggtacgggttcgggtcccgggtacgggttcgggtcggggaccggggaaacggaccgaacggtccggtaccggtaccccgttacggttaccgggaccaaccggacccggtaaccgg

SEQ ID NO: 311805 - DNA, 783 bp, Homo sapiens
  misc_feature: GZ8MTXP02HN8SJ.25.36.D03.1.454.CMB.2.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctcagtgtcgtcgggaccccggnaggaggtcctccatctcttgtcgtgggancagctccgacgtacggaaattagttgtctacgtggtaccagcacgcctacccgaagaaacccggcccccaaagtccctcctactaatactaagtaaggaatggactcgacggccgccctacggaacgggactaccgtcgaaccgttatttccgtctcggggtacttacggaagttccgttcgggcccttccgtcccgggtccctcccgttcggaccctaacgttcgacggggttccggggtcccgttacccggggttaccgggaaggggtacttacgggaaccgggtaccgtttaacggttaaaattttacgtttaacccgggtttgggtaacggtacccggtttaagggggtttcgggtaaagttcccgggtacccgttaggggttacgttacggggttcggggtttaccgggttaccccggggtacgggggtttacggggttcccgggggaccggggaaaccggggtaaccctaaacggggtcccggtttaacgggaccccgtttaccggacgggttacccgacgggtaacccgtaacccgggg

SEQ ID NO: 311806 - DNA, 657 bp, Homo sapiens
  misc_feature: GZ8MTXP02FWHYF.25.36.D03.1.454.CMB.2.raw
  modified_base (353)..(353): a, c, t, g, unknown or other
  misc_feature (353)..(353): n is a, c, g, or t
tcagactgtacagtcacgaccggtgctcgatttagctgcgtcacgatctctcttggggagcttcagctgtggtagagaagacaggattcaggacaatctccagcatggtcggcctccctctcctcctcaccctcctcactcactgtgcagggtcctgggcccagtctgtgctgactcagccaccctcagtgtcgtcgggacccccgggcaggagggtctccatctcttgttctgggagcagcctccgacgtacggaaattagttgtctactggtaccagcagcctcccaagaacccggcccccaagcctccctcatctataggaatgatcagccggcctgacgggactaccgngaccgtatttcctacgtgggcctacggtaagttccgtgggtccctcccgtccgggtccccttcccgtacggccctagtccgagggttcgggcccgtcccgggtaccggagggtagtcggaggtcctaaggtaactttagttaccgttggtacgtacgttagggtttagggattcggccgtagttcgtaggtacgggttccggggtaccgggtacggggttcgggttaccggggacgggaacggggacccaaggtccgtaccggtacccggttacgtaacggtccgaaccggacccgtaaccggg

SEQ ID NO: 311807 - DNA, 667 bp, Homo sapiens
  misc_feature: GZ8MTXP02FONXM.25.36.D03.1.454.CMB.2.raw
  modified_base (267)..(267): a, c, t, g, unknown or other
  misc_feature (267)..(267): n is a, c, g, or t
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
  modified_base (389)..(389): a, c, t, g, unknown or other
  misc_feature (389)..(389): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtggggggagcgtggtccagccgtgggagtccctgagctctctgtgaagcctntggtatttagttcagtggttctggcatgcacgtgggtcccnccaggcctccgagggcgaagggggccgtagtgggtggctagttanacgcaactagtgagtggggaaatttcgtagaaattnttaatgactaagtaccgttacccggtagggaaacggggtcctaattaccaccctatccgtaccaagacgtaactaaaccgttaccccggaaattagttagttagttaccgttaaggaaagttcgggttacaacggtccgttaggaaggtacggttaccggaacgggtaccgttcggggtacttaccgttaggtttaaactttaccgttaggcggtaccgggtaaaacggtcgggttacgggggtaaagggtttcggggttaaacggttttaaacgggg

SEQ ID NO: 311808 - DNA, 569 bp, Homo sapiens
  misc_feature: GZ8MTXP02JV05H.25.36.D03.1.454.CMB.2.raw
  modified_base (321)..(321): a, c, t, g, unknown or other
  misc_feature (321)..(321): n is a, c, g, or t
  modified_base (533)..(533): a, c, t, g, unknown or other
  misc_feature (533)..(533): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccagtccgccgggagggactggagtggattgggcgtatatatacgaatggattaaccacctacaacccctcctcaagagtcgagtcacatatcagcgacacgtccagggatcgaggtgttcctgcatctgacttcngcgactgccgccgacacggccctatactacgtgtcgaccagacgtattcgggaactggacgtacgtagttttcggaagtattattattctttgtgtctttagactatggtggtaccagggacgacggtcaccgtctcttcacgcctccgaccgtacggccctacgtccggtacctcccccgtcggccctaccctaccctaccgaacgaaccnccgtacccgtcggtcggggaccaccggacgcccggg

SEQ ID NO: 311809 - DNA, 630 bp, Homo sapiens
  misc_feature: GZ8MTXP02G3HNO.25.36.D03.1.454.CMB.2.raw
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
tcagactgtacagtcacgaccggtgctcgatttagctgcgtcacgatctctcgttggggggggtctcaggaggcagcactctcgggacgtctccaccatggcctgggctctgctcctcctcagcctcctcactcagggcacaggatcccgggctcagtctgccctgactcagcctcgctcagtgtccggtctcctggacagtcagtcaccatctcctgcactggaaccagaagtgatcttggtgcttatgacactgtctcctggcacctagtttacccaaggtaaaacnccccagacgtcatcctttangatgtnaggaagcggccctcgacggggtccctgactcgtcttcgtcgtcgggtaccaaaatcgtacggacaaaccgaccggtccctacccgtacgaaccctatccgtcgtcggggtcctccggaagggtcctagggacggtagtacggagggtactaggttaatttatttacttggtccttaggttactaattaagtcgacgtaggtaacctaaacgttacgttaaggtttttgggtcggttacggaccgtacggaacgggtaacccgtaaaggttcggtaacccggttcggtacgggtacaccggtaccccgtaaccggg

SEQ ID NO: 311810 - DNA, 532 bp, Homo sapiens
  misc_feature: GZ8MTXP02I9G8S.25.36.D03.1.454.CMB.2.raw
  modified_base (203)..(203): a, c, t, g, unknown or other
  misc_feature (203)..(203): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
  modified_base (423)..(423): a, c, t, g, unknown or other
  misc_feature (423)..(423): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgcttcttttaagaggttgtccactgtcaggtncacctggtggagtcgtgggggagcgtggtccagccgtgggacgtcctgagactctctgtgancctntggatttagttcagttggttcnggcatgcacgtggtccncgaggctccgaggcgaaggggccgagtcggtgctagttangcantgatgggattcagaatnttangacagctcgtagacggctatcactntctacagacgacacgttcccgaatnttgtacgtaacgtggaaattcggacacgctgagcgtacggagtacctcggcttacgttgtaacgttcgtgtcgtcggagtacgggtgggtaggtcggttaagtttacgg

SEQ ID NO: 311811 - DNA, 619 bp, Homo sapiens
  misc_feature: GZ8MTXP02GTPDH.25.36.D03.1.454.CMB.2.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
  modified_base (501)..(501): a, c, t, g, unknown or other
  misc_feature (501)..(501): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcggggacccccggnaggagggtcctccatctcttgttctgggancagctccgacgtacggaaattaagttgtctactggtaccagcagcctacccaacgaaaccggcccccaaagcctcctcatctaataggaatgatcagccggccctgacgggactaccgtgacccgtattctctcggctacgaagtctcggcctccgtccggccctcccgtggccctagtcgacgtcgggcccgtccgggtcccggaggacgtgggacggtcgtagtaatttacttacgttggtgtccgttaagggtttggnttacggcctaaggtcgtaggtacggtgggttaacgggtacgggttcgggttacggggcgggaacgggtacccgaaggccgtacggtacccgttcggacggtccacggacccgaccggg

SEQ ID NO: 311812 - DNA, 579 bp, Homo sapiens
  misc_feature: GZ8MTXP02FZ93V.25.36.D03.1.454.CMB.2.raw
  modified_base (275)..(275): a, c, t, g, unknown or other
  misc_feature (275)..(275): n is a, c, g, or t
  modified_base (315)..(315): a, c, t, g, unknown or other
  misc_feature (315)..(315): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggttttccttgttgttatttttccaggtgtccagagtgaggtgcaggttggtggagtcgtgggggaggtcttggtccagccgtgggagggtccgtgagagtctcgtgtgcagcctcnggattcatcttcagtcgaccactacatggactgggtcccncaggctccgagggagggctggagtgggtgccgtatagaaataagntaagagttacaccanagaataccgcgcgtctgtagaaaggcagattacgattatctacaaganatagattaanaaacgtactcaacttgtaactcgtagaactaaaatgaaacacgtaaccctaacggaaaaaccggaggaaaccgacgggtacccgtagttaaacttaccgtagtaacgtacgtacggtacaggtaccgtaacggtacgttaaacccc

SEQ ID NO: 311813 - DNA, 513 bp, Homo sapiens
  misc_feature: GZ8MTXP02GCKAR.25.36.D03.1.454.CMB.2.raw
  modified_base (236)..(236): a, c, t, g, unknown or other
  misc_feature (236)..(236): n is a, c, g, or t
  modified_base (331)..(331): a, c, t, g, unknown or other
  misc_feature (331)..(331): n is a, c, g, or t
  modified_base (441)..(441): a, c, t, g, unknown or other
  misc_feature (441)..(441): n is a, c, g, or t
  modified_base (502)..(502): a, c, t, g, unknown or other
  misc_feature (502)..(502): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggcagagggtctccatctcttgttctgggancagctccgacgtcggaaataagttgtctactggtaccagcagctcccagaaaccggcccccaagcctcctcatctataggaatgatcagcgcctnacgggatacctgaccgattcctctgctcgaagtcctggctcctcggccctcccgtggccatcgagtcgggcctccggtccgaggatcggaggctagaattattactggtncgtaggtttgggatcgccagtctgagtgtcgacggtgtcggcgaggccagcgtgaccgtcngcacgccacgg

SEQ ID NO: 311814 - DNA, 661 bp, Homo sapiens
  misc_feature: GZ8MTXP02H4F2D.25.36.D03.1.454.CMB.2.raw
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (310)..(310): a, c, t, g, unknown or other
  misc_feature (310)..(310): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggttttccttgttgttatttttccaggtgtccagagtgaggtgcagttggtggagtcgtgggggaggcttggtccagcctgggagggtccgtgagagtctcctgtgcagcctntggattcatcttnagtgaccactacntggactgggtccncaggctccgagggagggctggagtgggtgcccgtatagaaataagctaagagttacacacaagaactacgccgcgtctagtagaaaacggcaagtacttacaatttactactacgaaagagtaataggtaaactttacgaaaaagtaaccttcaaccgttagtaaactccgttagaacctaaaaagttcgaaaacgacggtaaccccgttaaaacggaaaaaaccccgggagggaaacccgaaacccggggtcccggtttaggttaaaaccttttaccgtgggtaacggtacccgtttaaagggggtaccctaacgggtaaacccgtttaacggggtaccgttaaaacccc

SEQ ID NO: 311815 - DNA, 594 bp, Homo sapiens
  misc_feature: GZ8MTXP02IUIJI.25.36.D03.1.454.CMB.2.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggaaccccgggnagagggtctccatctcttgttctgggancagcctccgacgtacggaaataagttgtctactggtaccagcagctcccagaaccggccccaagctcctcatctataggaatgatcagccgcctcgagggactaccgtgaccgtattcctctgggcctcgaagtccgtggctccgtcggcccctcccgtcggcccatcgaggtcggccgtcccggtccggaggcgtggagggtctaggaaattagttacgtggtgtcgtaggtttcgggatcggccgtagtcgtggtacggttcgggtccggtacgggttcggttcggggacgggacggggaccgtaaggccgtacggtacccggtaccgtacgggtaccgacggacccgtaaccggg

SEQ ID NO: 311816 - DNA, 589 bp, Homo sapiens
  misc_feature: GZ8MTXP02GIOZU.25.36.D03.1.454.CMB.2.raw
  modified_base (345)..(345): a, c, t, g, unknown or other
  misc_feature (345)..(345): n is a, c, g, or t
  modified_base (407)..(407): a, c, t, g, unknown or other
  misc_feature (407)..(407): n is a, c, g, or t
  modified_base (529)..(529): a, c, t, g, unknown or other
  misc_feature (529)..(529): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttcgtggttaccacctttagcagctatggcatcagcgtgggtgcgacacggcccctaggacaggggtcttggagtggatggacagtggatcgagtaccttaaacntcggtatcgaacagactatcgcagaggtaacttccgagggacagacgtcacttgaaccaganacacactaccgaacgagaccaacgacgaccctaagacgtacggaccgaggaaggacgtaccgtagaacggtacttacgtacgaaacccgaacgtaaccgggtaccctttaagtaatttacgngtacggacgagttacgtaacgtaattacgtacgtccgtttaacgtccggtactaacccgg

SEQ ID NO: 311817 - DNA, 590 bp, Homo sapiens
  misc_feature: GZ8MTXP02JEQDV.25.36.D03.1.454.CMB.2.raw
  modified_base (242)..(242): a, c, t, g, unknown or other
  misc_feature (242)..(242): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcacatctcctgcactggaaccagccgtgacattggtncttataactatgtctcctggcccaacaacacccagcaacgcccccaaatcatcattatgatgtcagtcatcgcctgtggtatttcctggtcgtcttctctggtacctccaagtctaggtccaactccggcctcccgtgacctagtcgtcggggcctccgagccgtgacgggtacgacggtcttaaaccgttatttaattcggtcttattttaccaattaccgagaacgaccaacaactagttcgcgggtttcgttacggggacggtaacgggtacctaaaggttcggaccccgttaccgtcggtaaccgacggtaccccgaagggcctccgacccccgttacggtccc

SEQ ID NO: 311818 - DNA, 594 bp, Homo sapiens
  misc_feature: GZ8MTXP02H6G6A.25.36.D03.1.454.CMB.2.raw
  modified_base (221)..(221): a, c, t, g, unknown or other
  misc_feature (221)..(221): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (272)..(273): a, c, t, g, unknown or other
  misc_feature (272)..(273): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (296)..(297): a, c, t, g, unknown or other
  misc_feature (296)..(297): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (341)..(341): a, c, t, g, unknown or other
  misc_feature (341)..(341): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagacccctgtccctcacctgcagtgtctctggtggctccgtcagtgcttatactggagctggatccgccagtccgcgggagggactggagtggattgggctanatatacgaatggattaaacactacaaccctcctanaagntcanacacatannagngacacacgagatngtgtctnnatntntactctncgacncgcgaccgacgacgactatactactgnacagagagtacgacgtcgcgtacgtacgtttagtaagtaaattaattatttatttagttgttagtttagttacgtagtaggtgggacggaacgggtaacggaacggtacgtaccgttacgtactactacgaccgtacccgaaccgaaaccggtacccgtacgtaccggttcccgttccccgtccgtacctacccctaccctaacccgaaacgaacgaccgtaccgtaccggtacgggaccgaaccgacgccgg

SEQ ID NO: 311819 - DNA, 622 bp, Homo sapiens
  misc_feature: GZ8MTXP02FI6CR.25.36.D03.1.454.CMB.2.raw
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtgtcttaataactatgtcctcctggtaccccaacaaccacccgaggaccaaccggacccccaaactcaatcctatttatgatgtacagtcagttccgccctgtcggtagtttctcgggtcgtcttcctctcggtctcctaagtctcgggacctaaccgtccggtcccctcccgtacgaccctacgttcccggtaccgggggtccctcccgacgggtcgtacgggaacggacggacggtactttaaccttatttattgtactatttacgataacagaacgaaccaaccaactgtcgtaggttcggttacgggacgggtaacggaccgtagttccgaccgtccgttcgcgaccgtaccacggcctccgcccgtcggtaccc

SEQ ID NO: 311820 - DNA, 620 bp, Homo sapiens
  misc_feature: GZ8MTXP02HVNAD.25.36.D03.1.454.CMB.2.raw
  modified_base (207)..(207): a, c, t, g, unknown or other
  misc_feature (207)..(207): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagagggtctccatctcttgttctgggagcagctccgacgtcggaaatagttgctactggtaccagcagcctcccgaagaaccggcccccaagcctcctcatctataggaatgatcagccggcctgacgggactaccgtgaccgtattcctcgtcggtcctcggaaagttccgtagggtcccttcccgtcccggccccttcccgtcggcccagtccgaggttcggggcccttcccggggtcccgagggtatcgggaaggtccgttagtaaacgtttattacgtggtcgtacgtaggtttggggatcggtactaggttcgtaggtaggttcgggttccggacggttggttaccgggcgggtacggacccgaaggtccgtacggacccgttcgtacggtccgacgacccgtaacgg

SEQ ID NO: 311821 - DNA, 547 bp, Homo sapiens
  misc_feature: GZ8MTXP02G97OJ.25.36.D03.1.454.CMB.2.raw
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgcccctgactcagcctgcctccgtgtctgggactcctggacagtcggtcaccatctcctgcacgtaggaaccagccgtagactagttggtgtcttataactatgtctctcgtcccaacaccaccagcaacgacccccaatcatcattatgatgtcagtcatccgcctntggtnttccngtcgtntctntcgctcagtctcgcacgtcgcctccctgaccncgtcgcggcctcgngtcnggacggacacggtcttacttatttatcgtcttatttcaaacgacgacgaacgaaccaaccaactaagtccgtggttcggtacgggcggacggtacgtaagttcgaccgtcgttacgaacgcgacccgtagccgtccgccccgttggaccc

SEQ ID NO: 311822 - DNA, 605 bp, Homo sapiens
  misc_feature: GZ8MTXP02JOI36.25.36.D03.1.454.CMB.2.raw
  modified_base (532)..(532): a, c, t, g, unknown or other
  misc_feature (532)..(532): n is a, c, g, or t
  modified_base (575)..(575): a, c, t, g, unknown or other
  misc_feature (575)..(575): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagctgggttttccttgttgttatttttccaggtgtccagagtgaggtgcagttggtggagtcgtgggggagcttggtccagccgtgggagggtccgtgagagtctcctgtgcagcctctggatcatcttcagtgaaccactacatcggactggggtcccgccgagggcctccggaggggaacggggctaggggaggtggggttcggaccccggttaagttaagaaaattaaaggactaaaaggtagtttaccaacctaacaaggaaactaccggaccgcgttactaggtaggaaaaggcaagtattctaattactactacgaagagattagaactttacaaaagtaactcaacgttagtaatcagtacaaaatgaaacngacctaacgaaaaccgagaaccgacggtccgtagtacttacgngtgacgtaggtcagtacgtacggtactacc

SEQ ID NO: 311823 - DNA, 707 bp, Homo sapiens
  misc_feature: GZ8MTXP02IWTME.25.36.D03.1.454.CMB.2.raw
  modified_base (244)..(244): a, c, t, g, unknown or other
  misc_feature (244)..(244): n is a, c, g, or t
  modified_base (310)..(310): a, c, t, g, unknown or other
  misc_feature (310)..(310): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactattggtntcttataactatgtctcctcgtacccaacaaccacccaggcaacgacccccaaactcatctattangatgtcagtcacgtccggcctcgtggtacgtttccgtgtctcttctctcggctccgtagtcgtacggacctaaccgtccggtccctcccgtacgaccctacgtcccgtccgggggccttcccggacggtccgtacgggaacgggtaccggacggtaccttaaaccgtttatttaaacgttcggtacttaacgttttaccgaaacttaaccgtaacgaaacgtaacccaaacccgtaaacgtacgttacgttacgggttccgggttacggggaccgggtaaacggggtaaaccgtaaacgggtttccgaaccccggtttcccgtaccgggtaacccgaaccggtaccccgtaaacggggtcccccgtaccccggtacccccggttaccgttacccccg

SEQ ID NO: 311824 - DNA, 583 bp, Homo sapiens
  misc_feature: GZ8MTXP02FLO84.25.36.D03.1.454.CMB.2.raw
  modified_base (269)..(269): a, c, t, g, unknown or other
  misc_feature (269)..(269): n is a, c, g, or t
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagccgtgggaggtccctgagactctcctgtgaagcctntggtatttagttcagtggttctggcatgcacgtgggtccnccaggcctccgaggcgaaggggccgagtggttgcaggttanagcacatgatgggaattctagaattattaatgacagtactccggtagaacggggtccattccacctatcctccaagacgaactaacgttcccggaaactagttagtagttaaccgttaggaaaagttcgggtacaaggcctaggaacggtaggtcggaacgggtacctcgggtcttacgttacgttaattcgtggtgcgaggtacggtgggggtaggtggtaggtttaaacgg

SEQ ID NO: 311825 - DNA, 690 bp, Homo sapiens
  misc_feature: GZ8MTXP02HVA9T.25.36.D03.1.454.CMB.2.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccgggnaggagggtctccatctcttgtctgggancagctccgacgtcggaaatagttgtctactggtaccagcagcctaccagaaccggcccccaagctcctcatctataggatgatcagccgccctcgacgggactaccgtagaccgtattcctctggtatcgtaacgtcgtggcctcccgtccggccctcccgtcggccctagtccgaggttcggggtccttccggggtacccgagggtacgttacgggacgggttccttaggtaaaacgtttacgtttaaccggtgggttcgtaaccggttagggtttttacgggggaacgttcggtaccccgtaagggttcccgttaggtaacgggtttcggggttaccccgggtaacggggtttcgggttccggggtaccgggggaacgggttaaccccgaaaggtcccgtacggtaccccggttccccgttagggttacccgacggtaccccgtaaccggg

SEQ ID NO: 311826 - DNA, 622 bp, Homo sapiens
  misc_feature: GZ8MTXP02JLE04.25.36.D03.1.454.CMB.2.raw
  modified_base (247)..(247): a, c, t, g, unknown or other
  misc_feature (247)..(247): n is a, c, g, or t
  modified_base (314)..(314): a, c, t, g, unknown or other
  misc_feature (314)..(314): n is a, c, g, or t
tcagactgtacagtcacgaccggtgctcgatttagctgcgtcacgatctctcttgggggggtctcaggaggcagcgctctcgggacgtctccaccatggcctgggctctgctgttccctcaccctcctcactcagggcacagggtcctgggcccagtctgccctgactcagcctgcctccgtgtcctgggactcctggacagtcggtcaccatctcctgcactgggaaccagccgtgacattgggtncttataactatgtctcctcggtccaacaacacccaggaccaacggcccccaaatcactcctatttangactgtacagtctactccggcctgtggtactttccgtggtccgtcttcgtcgtggccttcgaacgttctaggcctaaccgtcggccctcctcgacctactccgttcgggcttccgagcgtggaacggcacggctttaacgttaattcgttacggacttatttacaacttacgaacggacgaacctaacacgaacgttcctgggtacgttacgggacggtaaacgggacctaaacggttcgtaaccccggtccgtaccggttaacgaaccgacccgttaacgggcctcccggtacccccgtacggtccc

SEQ ID NO: 311827 - DNA, 656 bp, Homo sapiens
  misc_feature: GZ8MTXP02HESX3.25.36.D03.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggacccccgggnaggaggtcctccatctcttgtctgggancagctccgacgtacggaaatagttgtctactggtaccagcacgcctaccaacgaaaccggcccccaagcctcctcatctaataggatgatcgacgccgtcctagacggtactacctgaccgtattcctctggcctcgaacgtcgcggtcctcccgtcccgggtcccttcccgtcggaccctacgtccgacgggtcgggtcccgtcccgggtacccgagggtacgtgggtaacgggtccttaagtaaacgtttaacgtttaacgttcgggttacgtaccggttaggggttttcgggaacgttcggtacccgtaggttcgtacgggttacgggtccggggtacccggtagggttcgggttccgggacggggtacggaccgaacggtcgtacggaccgtcgtaggaccaccggacctaaccgg

SEQ ID NO: 311828 - DNA, 646 bp, Homo sapiens
  misc_feature: GZ8MTXP02F26K5.25.36.D03.1.454.CMB.2.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (347)..(347): a, c, t, g, unknown or other
  misc_feature (347)..(347): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccggnaggagggtctccatctcttgttctgggancagctccgacgtacggaaatagttgtctacgtggtaccagcagcctaccaagaaccggcccccaagcctcctcatctatagaatgatcacgccgcctcgacggactaccngaccgtattcctcgtggcctaggtaacgtccgtcggtcctcccgtccgggccctcccgttcggccctacgtcgagggtcggccgttcccgggtaccggaggtacgtggaaacggtctagtaaattattacgttggtgtaccgttagggtttaggcgttacgccgtaagtccgtagggtacggttacggggtccggttacgggggttcgggttccggggaccgggggtaaccggggaccgtaaacggtccgttacggtacccggttacccggtaggtacccgaccggtacccgtaacggg

SEQ ID NO: 311829 - DNA, 644 bp, Homo sapiens
  misc_feature: GZ8MTXP02I0TI3.25.36.D03.1.454.CMB.2.raw
  modified_base (272)..(272): a, c, t, g, unknown or other
  misc_feature (272)..(272): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgttatttttctaggtgtccagagtgaggtgcaggttggtggagtcgtgggggagcttggtccagcctgggagggtccgtgagagtctcctgtgcagcctntggattcatcttcagtcgaacccatacagtggactcggggtcccgcgaggcctaccggaggggaaggggctggggaggtggggttgcccgttaagttaagaaaataaagctaaagacgttacacacagaactcgcgagtctagtagaaagcaagattacattatactagaaagagatagtaattaacgaaacgtaacttacctaattagtaactacttagacctaaaaaattcggaaaacgacgtaacccgtaaaacggaaaaaccccgggaagggaaacccgtaaccggggttacccgttaggttaaacttacgttaggtaacgtaccgttaaggttacgaaggtaccgttaacgggtacgtttaaacccc

SEQ ID NO: 311830 - DNA, 638 bp, Homo sapiens
  misc_feature: GZ8MTXP02IMWSN.25.36.D03.1.454.CMB.2.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (282)..(282): a, c, t, g, unknown or other
  misc_feature (282)..(282): n is a, c, g, or t
  modified_base (322)..(322): a, c, t, g, unknown or other
  misc_feature (322)..(322): n is a, c, g, or t
  modified_base (330)..(330): a, c, t, g, unknown or other
  misc_feature (330)..(330): n is a, c, g, or t
  modified_base (466)..(466): a, c, t, g, unknown or other
  misc_feature (466)..(466): n is a, c, g, or t
  modified_base (502)..(502): a, c, t, g, unknown or other
  misc_feature (502)..(502): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtcgtcgtcgggacccccggnaggaggtcctcatcttcttgttcgtgggancagcctaccgacgtacggaaattagttgcttacgtcgtaaccngcagcctacccgaaggaaccccgccccaaagtcctacctnatcgtaanaaggtatgactcgacgccgccctagacggtactaccgtacgaccgtattcctacgtcgggtactacggtacgtccgtcgggtcctcccgtccggacccttccgcggaccagtcgacggtcggccgtccggcgaggngtacggcggtactagtaaactttgtacgtggtacgngttagggttaggactcgtaccgtaggtcgttggggtcggttcggggtccggtacggggttcggttaccgggggacgggaacgaccgtagtccggttacgacccggttcggtaaggacccgaccggacccgtaccgg

SEQ ID NO: 311831 - DNA, 662 bp, Homo sapiens
  misc_feature: GZ8MTXP02F18PM.25.36.D03.1.454.CMB.2.raw
  modified_base (180)..(180): a, c, t, g, unknown or other
  misc_feature (180)..(180): n is a, c, g, or t
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
tcagactgtacagtcacgaccggtgctcgatttagctgcgtcacgatctctcttggggtgtgggctcagaagcagagttctgggggtgtctccaccatggcctggaccccctctctggctcactctcctcactctttgcataggttctgtggtttcttctgaactgactcaggaccccgntgtgtctgtggccttgggacagacagtcaggatcacatgaccaaaggagacagcctcaagtaacttatatgcatcctggtaccagcagaacgccggacacggcccctntacttgtcttctacggtacaaaacccnccccgcccctacgacgggtactcctacgacgaccgtattccctcgtcggcctcccgacctaccgaaacggaaccacgacgtccttcccgttacgaaccctatccaacggttcgggggccttaccggacgggccgaacgaaaggtagtacggaggtccgtagtaaccttaagtttaccgttcggttaccccgtacccggggaacctacccggtaggtacggtaaacgtcgtaagggtttcggtcgggttacgttcggggacgggtacgggaccgtaaggggtcgtaccggtccgtacggtacacggacccgtaaggcctccggccccgtcggtccaccgtcgttcccg

SEQ ID NO: 311832 - DNA, 533 bp, Homo sapiens
  misc_feature: GZ8MTXP02GSSV6.25.36.D03.1.454.CMB.2.raw
  modified_base (261)..(261): a, c, t, g, unknown or other
  misc_feature (261)..(261): n is a, c, g, or t
  modified_base (383)..(383): a, c, t, g, unknown or other
  misc_feature (383)..(383): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcgtggtttctgtagtattttccagtgtcagagtgaggtgcagttggtggaggtcgtgggggaggcgttggtcgagccgtggagggtcggtgagagtctcctgtgcngctctggattcatcttcagtgaccactacatgactggtccgccacggctcccagggaaggggcgtggaggtgggtgggcccgtagttaagaaataaagataagtaagttacaccaacagaanacgacgcgtctgtgaaaggacganatatatatntaanagagananatanaanacatatatatanananaananaacgacgacgaacgaaacgaacgacgacgacgtacgtactagtagtgtacgtacgtacgacgtacgtacgtacgtac

SEQ ID NO: 311833 - DNA, 676 bp, Homo sapiens
  misc_feature: GZ8MTXP02GYEK8.25.36.D03.1.454.CMB.2.raw
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (229)..(229): a, c, t, g, unknown or other
  misc_feature (229)..(229): n is a, c, g, or t
  modified_base (233)..(234): a, c, t, g, unknown or other
  misc_feature (233)..(234): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctgggacccccgggnaggaggtctcatctnttgtcgnggannagctccgacgtacgaaatagttctctacgtgacagcagcctaccaacgaaacccgccccaagtcctacctacactacgtaagtaagaatgactcgacggtccggtacccctagaacgggtaacttaccgtacggaaccgtattcctcgtcgggccttaacggtaaacgttccgtcggtacccttccccgtcccggtccccttcccgtacggaccctacgtccgtacggtcgggtaccggtaccgggtaccggaacgggacgtacggaggtacgtagtaaagttaacgttacgttacgtagtacgtaggttagggtagtacgtacgtacgtacgtacggtacggtacgggtacgggtacggttacgggttacggtacgggaacgggaaccgtaacggtaaccgtacgtaccgtaccggtacggtacggtaccggacccgaacg

SEQ ID NO: 311834 - DNA, 675 bp, Homo sapiens
  misc_feature: GZ8MTXP02HBNBZ.25.36.D03.1.454.CMB.2.raw
tcagactgtacagtcacgaccggtgctcgatttagctgcgtcacgatctctcttgggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagagtgatctggtgctatgacactgtctcctggcacctacgtttacccaggaaacgcccccagagtccatcctttatgatgtcgaggaagccggccctcgaccggggtccctgactcgtccttctcgtcgggtacctaaatccgtaggccaacgaccggccctccctagaccctacttcgtccgtcggggccttcccggaggtccgtacggaggacgttggaacggtccgttaggtaagttttaatttaagtttacggtccctttggtttaccgtaattaaacgtggacccgttaaggggacctaaaacgttaccgtttaaggtttttacgggttacggtttaccgggtcggaaccggttaacgggggtaaacccgtaaaagggtttcccggaaaccccggtttcccggtttcgggggtacccaccggttaacccccgtaacccgggg

SEQ ID NO: 311835 - DNA, 778 bp, Homo sapiens
  misc_feature: GZ8MTXP02G45RQ.25.36.D03.1.454.CMB.2.raw
  modified_base (244)..(244): a, c, t, g, unknown or other
  misc_feature (244)..(244): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctctcactcagggcacagggtcctgggcccagtctgccctgactcagcctgcctccgtgtctggactcctggacagtcgtcacatctcctgcacgtggaaccagccgtgactattgggtnacttaataactatgtctcctcgtacccaacaaccacccaggaccaacggacccccaaatcatcatttatgatgtacagtcacgtccggccctcgtggtagtttcccgtgggttacctctttcctcgttcggaccttaccccgtaaaggttctacggggtaccctaaacccgttcccgggtcccccttaccccgttacgaacccctaacgttcccggttcccgggggcccttacccgaacgggcccgttagggaacgggaacggtacgggtacctttaaaccgtttaattttaagtttacggttaccttaaatttttacccgaaatttaaacccgaaaggtaacgtaaaacccgtaaacccccaaaagtaaacggttccgttaagggggtttcggtttaccggggtaccgggggaaacgggtaaaccccgttaaaagggtttcccggaacccgttcccggtttaccggtaacccgaacggaccccgtaaaacggggccctttaaccccggaccccccgtttcgggttaacccccg

SEQ ID NO: 311836 - DNA, 639 bp, Homo sapiens
  misc_feature: GZ8MTXP02HFSU5.25.36.D03.1.454.CMB.2.raw
  modified_base (230)..(230): a, c, t, g, unknown or other
  misc_feature (230)..(230): n is a, c, g, or t
  modified_base (322)..(322): a, c, t, g, unknown or other
  misc_feature (322)..(322): n is a, c, g, or t
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcacgtggaaccngccgtgactagttggtgtcttaataactatcgtctcctcggtacccaaacaaccacccaggaccaaccggcccccaaactcatctaatttangtatcgtcagtcagtccggcctcgtcggtactttcgtcggttcgtccttctcgtcggtcctaccgtagtccgtcggacctaacccgtccgtccctcccgtacgaccctacgttcccggtaccggggtcccttacccggacggtccgtacgggacggtaccggtacggttaccttaacgttttagttacttcgtacctatttacaacttacgaacgacgaaccacaacgtacgtcgtaggtcggttacgggacggaacggactaaggttccgaaccgttccgtacggtacgtaccgacccgaacggtccgtcccccgg

SEQ ID NO: 311837 - DNA, 627 bp, Homo sapiens
  misc_feature: GZ8MTXP02FWATI.25.36.D03.1.454.CMB.2.raw
  modified_base (189)..(189): a, c, t, g, unknown or other
  misc_feature (189)..(189): n is a, c, g, or t
  modified_base (258)..(258): a, c, t, g, unknown or other
  misc_feature (258)..(258): n is a, c, g, or t
  modified_base (364)..(364): a, c, t, g, unknown or other
  misc_feature (364)..(364): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgcttcttttaagaggttntccactgtcaggtgcactggtggagtcgtgggggagcgtggtccaggccgtgggacgtccctgagctcncctgtgaagcctctggtatttagtttcagttggttctggcatgcacgtcgggtccgccgaggctcccgagggccgaagggggccgtaggtgggttggctagtttanagcacatcgatggggtaattgtagaattagttatgcagtctcggtagaacgggcctattcacccgtattaccaccgaaagacgtaaaccgaacgtttacccccgggaaaacttatttacgggttaagtttaaccggttaacgggtaaaacgtgggggtttaccaaacggtccgtaggtaagtacggttacggacggtacgtcggacttcggttacgtagttacctggtaagcgagtaggtcgggtaggtaggtacgtttaagg

SEQ ID NO: 311838 - DNA, 521 bp, Homo sapiens
  misc_feature: GZ8MTXP02FWNWF.25.36.D03.1.454.CMB.2.raw
  modified_base (210)..(210): a, c, t, g, unknown or other
  misc_feature (210)..(210): n is a, c, g, or t
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcggggaccccccgggnaggagggtctccatctcttgttctgggagcagctccgacgtcggaatagttgtctactggtaccagcagctccagaaccgccccagcctcctcatctataggaatgatcagacggccctacgacgggatacctgaccgtattctctggctacgaagtctggctcctcgccctcctgccatcagtggcctcggcgngatgaggctagaatnttactgtgcgtagtttgggattggcctagtctgacgtggtcccggtaggtcgttcgggcggacgggtaccaagcgtggaccgtcgaggtcaacgcccaagg

SEQ ID NO: 311839 - DNA, 780 bp, Homo sapiens
  misc_feature: GZ8MTXP02GMMLR.25.36.D03.1.454.CMB.2.raw
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
tcagactgtacagtcacgaccggtgctcgatttagctgcgtcacgatctctcttggggtgtgggctcagaagcagagttctgggggtgtctccaccatggcctggacccctctctggctcactctcctcactctttgcataggttctgtggtttcttctgaactgactcaggaccccgctgtgtctgtggccttgggacagacagtcaggatcacatgaccaaaggagacagccctcaagtaaactttatatgctatcctaggtaccagcaagaagccgggacacggcccctntacttcgtcttacgtacggtacaaaaccnccccgccctgacggactctcagaccgtattccctctcggcctccgccctacgaaacgggaaccacgactcctttacccgttcgaaacccattcccgaaacgttcgggggaccctacgacgggccgaacgaaaggtagtaggacggtaccttagtaacttaactttaacccgttccggtttacccccgttaccccgggggaacccctaacccggtaagggttacggttaaacggtccgtaagggggttttcggttacgggttcggtttaccgggggaccgggggtaaaacgggggtaacccggtaaaacgggggtttccgggaaacccccggtttaccgggtttaaaccggggtacccgtaaccgggtaacccccggaaaaccggggttccccgttaccccgggtccccccccggttaacggggttcccctaaacccgtttcccggttttccccccggg

SEQ ID NO: 311840 - DNA, 567 bp, Homo sapiens
  misc_feature: GZ8MTXP02GYBBP.25.36.D03.1.454.CMB.2.raw
  modified_base (292)..(292): a, c, t, g, unknown or other
  misc_feature (292)..(292): n is a, c, g, or t
  modified_base (366)..(366): a, c, t, g, unknown or other
  misc_feature (366)..(366): n is a, c, g, or t
tcagactgtacagtcacgaccggtgctcgatttagctgcgtcacgatctctcttgggggggtctcaggaggcagcactctcgggacgtctccaccatggcctgggctctgctcctcctcagcctcctcactcagggcacaggatcccgggctcagtctgccctgactcagcctcgctcagtgtcccggtctcctggacagtcagtcaccatctcctgcactggaaccagaagtgattcgttggtgtcttatgacactatctcctggaccacctagtttacccaaggaaaccnccccaagacgtacacttacctttatgattgtacgaggaaagcggccctcgaccggggtccctgactcgcttccncgtcgggtaccaaatcgtacggaccaaccgaccggtcccttccccgtagaaccctactccgtcgtcgggtcctccgacggtccgtgaggtacgtggaaggtctagtatttattagttggacttgtactatatgacgagacactactagttgttgtcgtcgcgacgacgtaacgtcgtacgtcgtcgtcgacgacgaaccgg

SEQ ID NO: 311841 - DNA, 750 bp, Homo sapiens
  misc_feature: GZ8MTXP02GHGRZ.25.36.D03.1.454.CMB.2.raw
  modified_base (212)..(212): a, c, t, g, unknown or other
  misc_feature (212)..(212): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtcgtccgtcgggacccccggngacggagggtcctccattctcttgttcgtgggagcacgctaccggacgtacggtaaattagtttcgtctacgtggtacccagctacgcctacccgaaacggaaaccccggcccccaaagtccctaccctactaactaccgttaaagttaagggaaattcggaacttccgaacggcccggacccccttaggaccgggtaactcccgtaggaaccctatttccgcgtggtccttacggaacgttcgtcgtccctacccgtccggccccttacccgtcggaccctacgtacgtacgggttccggggccctttcccggggtaccgaggaccgttggaaccggtacgttaggtaaaacttttacgttaccgttcgggtagtaccgtttaagggtttcggggactcggtaacccgtggtttaccgaagggtacgggtttccggttacccgggtaggggtttcgggttacggggacggggaacggaaccgtaacggtcgtacgtaacccggtcggtaacgtccggaaccggtacccgtaaccggg

SEQ ID NO: 311842 - DNA, 612 bp, Homo sapiens
  misc_feature: GZ8MTXP02JIFMG.25.36.D03.1.454.CMB.2.raw
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
  modified_base (305)..(305): a, c, t, g, unknown or other
  misc_feature (305)..(305): n is a, c, g, or t
  modified_base (413)..(413): a, c, t, g, unknown or other
  misc_feature (413)..(413): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggcagagggtctccatctcttgttcgtggancagctcgacgtcgaaatagttntctactggtaccagcacgtcctccgaacgaaccggccccaagcctccncatctagtaggaatgaatcgacgcgccctgaccgggactacctgaccgtatctcgtcggctagtaacgtcgtgcctcctaccgggtccctcccgtacggccagtacgngggtcggttccgcccgggttaccggaggtagcggtaacggggaccttagtaacgttactaccgttggtacgtacgtagggtttaggtacgtggtcctagtcgtcgtacggggttcggtacggtacgggttcgggttacggaccggggacgacgtaacggccgtaggtaccctcgggtacgacgaccggaccgtaaccgg

SEQ ID NO: 311843 - DNA, 704 bp, Homo sapiens
  misc_feature: GZ8MTXP02HFYIE.25.36.D03.1.454.CMB.2.raw
  modified_base (246)..(246): a, c, t, g, unknown or other
  misc_feature (246)..(246): n is a, c, g, or t
  modified_base (313)..(313): a, c, t, g, unknown or other
  misc_feature (313)..(313): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgactagttggtntacttaataactatgtctcctcgacccaacaaccacccagacaacgacccccaaatcatctattatnatgtcagtcagtccgcctgtggtattccgtggtccgtcttctcgtcggctccgtaagtctcgacctaaccgtccggcccttcccacgaccctacgtccgtcggggcctccgaggcgtagacgggacgtacggtacttaaacgtttattagtttacgtacttattttacgaaacttaaccgaaggaaactaaaccaaaccctaaaacgtcggtttacccgttaggggttcggttaccgggggaacggggaaaccggggtaaacccgttaaacggggtttcccggtaacccccggtttcccggttacccggggtaacccgtaacccgggaacccccgttaacggggcccccgttacccccgggtaccccccccgtttacggggttaccccccg

SEQ ID NO: 311844 - DNA, 641 bp, Homo sapiens
  misc_feature: GZ8MTXP02JVUMT.25.36.D03.1.454.CMB.2.raw
tcagactgtacagtcacgaccggtgctcgatttagctgcgtcacgatctctcttgggggggtctcaggaggcagcactctcgggacgtctccaccatggcctgggctctgctcctcctcagcctcctcactcagggcacaggatcccgggctcagtctgccctgactcagcctcgctcagtcgtccgggtctcctggacagtcagtcaccatctctgcactggaaccagaagtgatcttggtgtcttatgacactgtctcctggcaccgtacgtttaaccccaaggaaaccgcccccagacgtcacttccttatgtatgtacgaggaacgccggccgtcgaccggggtccctgactcgtcttctcgtcgggtacctaaagtccgtaggacctaaacgacccggtcccttacccgtacgaaccctagttcccgtcggtcgggtcccttaccgaacgggtccgtaggaacggtagttagggacggtcgttagtaagtttattaggttacgtcgttggtttaacctattacgttacgacgtacggtactaaacgttacgtttagtttcgggtacgttcggccgtacggacggtaaccgtaacggttcgaaccggttcggtacgggtaccacggacccgtaacgg

SEQ ID NO: 311845 - DNA, 527 bp, Homo sapiens
  misc_feature: GZ8MTXP02FNVI6.25.36.D03.1.454.CMB.2.raw
  modified_base (243)..(243): a, c, t, g, unknown or other
  misc_feature (243)..(243): n is a, c, g, or t
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
tcagactgtacagtcacgaccggtgctcgatttagctgcgtcacgatctctcttggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacattggtncttataactatgtctctggtcccaanaacaccagcaagccccaaatcatcattangatgtcagtcatcggcctctggtagtttcctggtcgcttctctggctccaagtctggcaactcggcctccctgaccatccgcggggctcccgaggctgacggacgaggcttacgttattattgactatttcaatacagtagacacaacagtactggtcgttcggcggacgggacctaaagttcgaacccgtccgcggtccgacgcccaagggcctcgccccctggtccc

SEQ ID NO: 311846 - DNA, 796 bp, Homo sapiens
  misc_feature: GZ8MTXP02JX6RU.25.36.D03.1.454.CMB.2.raw
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgtttatttttccgaggtgtccagagtgaggtgcaggttggtggagtcgtgggggagtcttggtccaggccgtgggagggtccgtggagtagtctcctggtcgcagcctcgtggtattcattcttcagtcgaccctactacagtggacgtcggggtcccgccgacgggccgtaccggaggggaacggggtcgtaggggaggttggggttcggaccccgttaagttaaacggaaaagttaaaacggcgttaaaaggaacgtttaccgaaaccccaaacgtaaacggtaaactaacccggtccccggtacgttaccgtacggggttaaagtaaaaacgggggccctaaagggtttaactttacccgtaaattttaactaccgttaaccgaaaagggtaacgtaagttaacggtaaactttaaacgaaaacggtaaccctacgtaaaccttaggtaacgttaccctaggaaacctaaaagttacgaaaaccgtaacggacccgttaaaacggaaaaaccccgaggggaacccaccggggtcctttaaggtaacgtttaaccgttggtaaccggtacgtttaacggggtacaaccggtaaccgttaccggggtttacgttaaacccccg

SEQ ID NO: 311847 - DNA, 771 bp, Homo sapiens
  misc_feature: GZ8MTXP02FTGKF.25.36.D03.1.454.CMB.2.raw
  modified_base (178)..(178): a, c, t, g, unknown or other
  misc_feature (178)..(178): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (317)..(317): a, c, t, g, unknown or other
  misc_feature (317)..(317): n is a, c, g, or t
  modified_base (387)..(387): a, c, t, g, unknown or other
  misc_feature (387)..(387): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggtttcttctgaactgactcaggaccccgntgtgtctgtggccttgggacagacagtcaggatcacatgaccaaaggagacagccctacaagaactttattatgctatcctggtaccagcaggaacgccggacncggcccctntacttgtctcgtacggtacaaaaccnccccgccctacgaggactccgtcagtaccgtattcccctacgtcggacctcccgacctacgaaggaaccncacgtccttccgttagaacctagtccacgtcgggggacctcggacggccgaacgaaaggacgttacgggacggtcgttacggtaactttaacgtttaaccggtaccggttttacccccggtaccccgggggtaaccctaacccggttaacgggttacggggttaacggtaccggttaagggggtttacggttcggggttaccggtttccgggggaacgggggtaaccggggaaacccgggttaaagggggttaccggtaaccccgggttacccggttaacggggttacccgaaccggggtaacccccgaaacgggggtccccgttacccgggtacccccccgtttaccggggtccctaaccccgtttcccggttttaacccccg

SEQ ID NO: 311848 - DNA, 658 bp, Homo sapiens
  misc_feature: GZ8MTXP02HZ20Z.25.36.D03.1.454.CMB.2.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (367)..(367): a, c, t, g, unknown or other
  misc_feature (367)..(367): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtctccatctcttgttctgggancagctccgagtcggaaattagttgctactggtaccagcagcctacccgaagaaaccggcccccaaagtcctcctcatctaataaggaatgatcgacgccgccctagagggactaccgtcgaccgtattcncgtgggactacgacgtcgtacggtcctccgtcccggcccttcccgtacggccctagtccgagggttcgggcccttccggggtaccggaagggtacgtcgggaacggtcctaggtaaacgtttagttaccgtggtgtacgttagggtttggggaactcggtaccctaggttccgttaaggtacgggttccgggttccgggaacgggtttcgggttaccggggacggggacggtaaaccgaaggtcccgtacggtaccccggttcgtacggtaccgaccggtaaccccgcggg

SEQ ID NO: 311849 - DNA, 684 bp, Homo sapiens
  misc_feature: GZ8MTXP02HBVND.25.36.D03.1.454.CMB.2.raw
  modified_base (242)..(242): a, c, t, g, unknown or other
  misc_feature (242)..(242): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctctgcactggaaccagccgtgacattggtncttataactatgtctcctggtcccaacaacacccaggacaacggccccaaactcatcatttatgatgtcagtcatcggaccctctggtagttcctggtcgtcttctctcggctccaagtctcggctaaccgtcggcctccctcgacctacttccgtcgggggtcctcccgaggtccgtggacggaccggacggtacttaacgttatttaacgttcgtaccttatttactaaattaccgaaaggtacgaaccgtaaaccaaacgtaacggttacgttacggggttcggtttaccggggacggggttaacggggaacccggtaaacggggtttaccggtaacccggtttaccccggttccggggttaaccggtaaacccggtaccccggaaaacggggttccccgtaccccggttacccccccggttaccggggtttacccccg

SEQ ID NO: 311850 - DNA, 606 bp, Homo sapiens
  misc_feature: GZ8MTXP02G8GRI.25.36.D03.1.454.CMB.2.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
  modified_base (308)..(308): a, c, t, g, unknown or other
  misc_feature (308)..(308): n is a, c, g, or t
  modified_base (358)..(358): a, c, t, g, unknown or other
  misc_feature (358)..(358): n is a, c, g, or t
  modified_base (429)..(429): a, c, t, g, unknown or other
  misc_feature (429)..(429): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtcgtcgggacccccgggnaggagggtcctccatctcttgttctgggancagctccgacgtacggaaatagttgtctactggtaccagcagcctccaagaaccgccccaagcctccncatctatagatgatcgagccggcctacgaggactaccgtgaccgtattcncgtggctacgagtcctggcctccgtcgccctccctcggccagtcgaggtcgggtccacgtcgtagacggtntaggacggtctgtacttagttacgtcgacgcacggcgagtgggaacgtgaacgtacggtaccgttaggtaacgttggggttggttacggggttttaccgggggacgggtaaacggggtaacggaacggtccggttacggtaacccggttacccggttaacgggtacccaaacccggg

SEQ ID NO: 311851 - DNA, 632 bp, Homo sapiens
  misc_feature: GZ8MTXP02HQV7G.25.36.D03.1.454.CMB.2.raw
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttatactggagctggactccgccaggtccggccggggaggggactgggagtggagttgggctatatatacgaatggaattaaccacctaccaacccctcctanaagngtcgagtcaccatntcagcgacacgtccagggntcgaggtgttaccngctatctgtacttcgngccgtacgtcgcccggacgaccaccggtccctatactcgtgcgacgagtacgtacgttcgatcgaccgtagttagtttacggaattaatttatttattcgtttgttgtttcgtttagacgtggtagggtacgggacggaacggggtacgtacgtaccgtaccgttccttccgtacgccgtccctaccgaccgacggtccctacggttccccggttcccttccccgtccgtacccctaccctacccgtaaccgaacgtccgacccgtaccggtcggaccgggaccacggtacggcccgg

SEQ ID NO: 311852 - DNA, 718 bp, Homo sapiens
  misc_feature: GZ8MTXP02HCG91.25.36.D03.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacngtcgcaccatctctgcactggaaccngccgtgactattggtntcttataactatgtctcctcggtcccaacaacaccagcaacggcccccaaancatcatttangatgtacagtcatccggcctcgtggtagtttccgtggtcgtcgttctcgtcggtctccgtaaagttcgtacgggtacctaaaccgttcccgggtcccttccccgttacgaccctacgttcccgtcgggggtacccttccgacgggtccgtacggacgggaaaccgtacgggtacctttaacgtttaactttagttcggtaccttattttacccgaattaaacccgtagtaaccggtaacccaaaccgtaaacgtaacgtttacgtacggggtttcgggtttaccgggggacgggtaacggggtaaaccgttaaacgggtttccggaaacccgggttccgttaccggggtccgaaccgggttaccccggaaaacggggtcccgttcccggtacccccccggttacggtttacccccg

SEQ ID NO: 311853 - DNA, 577 bp, Homo sapiens
  misc_feature: GZ8MTXP02JE40D.25.36.D03.1.454.CMB.2.raw
  modified_base (341)..(341): a, c, t, g, unknown or other
  misc_feature (341)..(341): n is a, c, g, or t
  modified_base (421)..(421): a, c, t, g, unknown or other
  misc_feature (421)..(421): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaggtctctgcaaggcttctggttacaccttagcagctatggcatcagcgtgggtgcgacaggcccctggacagggcttggagtggatggcagtggatcgagtcctaacatcggatcanagactatcgcacgaggtaactccgaggcagacgtaccacttcgaaccacgacgaccaacactaccacgacgacaacgacnccaacgacgtggaccctagggacggacgtccgagacgtacgtaccgagaacgacccgtaaccggtaccggtaattaacgttaaccgtgggttacgacgtaagacggttaacgaacgtttagtacggtacgtttaaccgtccggtacgttaaccccg

SEQ ID NO: 311854 - DNA, 686 bp, Homo sapiens
  misc_feature: GZ8MTXP02JXWDC.25.36.D03.1.454.CMB.2.raw
  modified_base (244)..(244): a, c, t, g, unknown or other
  misc_feature (244)..(244): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacgagggtcctgggcccagtctgccctgactcagcctgcctcgtgtctggactcctggacagtcgtcacatctctgcactggaaccagccgtagactagttggtntacttaataactattcgtcctccgttacggaccccaaacaaccaccccgaaggaccaaaccggaccccccctaaaatccaacttacctaatttaatagaacttcggtacacggttaccaacgtcccgggtacccttcgtacggttacgtttccccgtggtcctctttccgtcgtacggcctccgtaagtcgttcggcctaaccgtccggccctttcccgagtaccctagtccgtacggggctccggagccgtagggaggaccgtaggtaccttaacgttattacgttcgaacttatttacaaagttacgaaaggtacgaaccactaaagtcgtacgttgggtccggttacggggacgggaaccggtaacgtaacggttcgaaccgttccgaaggttccgaaccggtaccgaacgggtccctcccggtccccgtacggtcccc

SEQ ID NO: 311855 - DNA, 502 bp, Homo sapiens
  misc_feature: GZ8MTXP02GHA33.25.36.D03.1.454.CMB.2.raw
  modified_base (349)..(349): a, c, t, g, unknown or other
  misc_feature (349)..(349): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagttgtctactggtaccagcagctcccagaaacggcccccaagctcctcatctataggaatgatcagcgccctcagggatacctgaccgattcnctggctcgaagtctgctcctcggcctccctggccatcagtggctcggtccgagatgagctgatattactgtagctagtttggatgccagtctgagtggtccgacggtggttcggcggaggaccagcgtgaccgtccaggtcacggcccaacgg

SEQ ID NO: 311856 - DNA, 792 bp, Homo sapiens
  misc_feature: GZ8MTXP02JRFZ9.25.36.D03.1.454.CMB.2.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (328)..(328): a, c, t, g, unknown or other
  misc_feature (328)..(328): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagaggtctccatctcttgttctgggancagctccgacgtcgaaatagttgtctatggtaccagcagctcccagaaccggcccccaaagcctcctcatctataggaatgatcagccgccctnacgggatacccgtgaacccgtattcctacgttggggacctacggtaaaggttcctcggggtcccttccccgttcccggggtcccccttcccccggttcggggaccccctaaagtttccccgaaacgggggtttccgggggtacccccgttccccgggggttacccccgggaaggggtaaccgtttgggaaacggggtccttaaagggtaaactttaacgtttaaccgtagggttcgtaccgtttaaagggttttgggggaacttccggggaccctaaacgggtttcgtaccggggttaaagggttccgggggttaccccgggttaacgggggtttccgggtttaccgggggacccgggggtaaaccggggtaacccgaaaacgggtcccggtacgggttaaacccccggttcccggttaaaccggggttacccgaaacccggtacccccggtaaaacccggggg

SEQ ID NO: 311857 - DNA, 631 bp, Homo sapiens
  misc_feature: GZ8MTXP02HLL52.25.36.D03.1.454.CMB.2.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccngccgtgactagttggtntacttatactntctctctcgaccaacaccaccacgacaaccgaccccaatcatctattatntatntctatcncgtccgtcctcgtgtgttccgtcgtctcttctcgtcgtctcgtacgtcgtacgacctaccgtccgtccctcccgtacgtacctcgtccgtccggtcctccgacggtcgtacggacggtacgtacgtacttacgtttatttacgttacgttacttacttacgaactaacgacgtaaccgaactaaccgtaacgttacggtacggttcgggttacgggtacggggtacgggtaacggtaacgttaacggtccgtacccgtcggtaccgtaaccgaccggtaccggtacgtcccgtcccggtacccgttaccgtcc

SEQ ID NO: 311858 - DNA, 561 bp, Homo sapiens
  misc_feature: GZ8MTXP02JYZ3B.25.36.D03.1.454.CMB.2.raw
  modified_base (217)..(217): a, c, t, g, unknown or other
  misc_feature (217)..(217): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacaggatcccgggctcagtctgccctgactcagcctcgctcagtgtccgggtctcctggacagtcagtcaccatctccngcactggaaccagaagtgatcgttggtgcttatgacactgtctcctggcaccagttttacccaggaaaagcccccagacgtcatcctttatgatgtcaggaagccggcctcgacggggtccccctgactcgcttctctgggtccaaatctggacaaccacgcctccctcgacccatcctcgtcgggctccgacggcgtcgagggatgaggctagtattattatgtactgttcatctagcgtaggactaaacgtacttagttttcggtcggtttccgggacgtcgaacggggtaaccgtaagttcggtacccgtcgtcgggtaccacggacccgaacggtccccg

SEQ ID NO: 311859 - DNA, 582 bp, Homo sapiens
  misc_feature: GZ8MTXP02IZV7F.25.36.D03.1.454.CMB.2.raw
  modified_base (238)..(238): a, c, t, g, unknown or other
  misc_feature (238)..(238): n is a, c, g, or t
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
  modified_base (408)..(408): a, c, t, g, unknown or other
  misc_feature (408)..(408): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctcagtgtcgtcgggaccccgggcaggagggtctccatctcttgttcgtggancagctccgacgtacggaaattagttgtctactggtaccagcagcctacccaagaaccggccccaagcctccncatctaataggaatgatcgacgccgcctgacggactaccgtgaaccgtnttcctcgtggtctcgaacgtccgtcggccttccgtccgcccttacccgngcccagtcgaggtcggcccgtcggtccgaggatggacgtctagtaacttgtactggtgacgtaggtttggattcggactagtcgtaggtacggttcggccggtagggttcgggttcgggacgggaacggtacccaaggtccgtacggaccgtacgtacggcacggcccgtacgg

SEQ ID NO: 311860 - DNA, 617 bp, Homo sapiens
  misc_feature: GZ8MTXP02JUK9I.25.36.D03.1.454.CMB.2.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (370)..(370): a, c, t, g, unknown or other
  misc_feature (370)..(370): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcggggacccccgggnaggagggtcctccgattctctttgttcgtgggancagctccgacgtacggaaatagtttgtctacgtggtaccagcagcctaccgacgaaaccggcccccaagcctcctcatctaatacggatgatcgagccgccctgacggactactcgaccgtattcncgtgctacgtagtcgtgctccgtccgtccctcccgttggccctatccgaggtcgggccgtcccgggtccgagggtacgtaggacgggtctaggtaacttagttaccgttggtgtcgttaggtttcggggatcggccgtagtcgtgtacggtcgggtaccggtacggtcgggttacggggccgggaacgggaccgtaaggccgttaccgggtaaccggttcggtacggaccgacggtacccgaccggg

SEQ ID NO: 311861 - DNA, 630 bp, Homo sapiens
  misc_feature: GZ8MTXP02GWA00.25.36.D03.1.454.CMB.2.raw
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (403)..(403): a, c, t, g, unknown or other
  misc_feature (403)..(403): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactattggtgtacttataactatgtctcctgtacccaacaacaccagccaacgacccccaaatcatcatttatagatgtcagtcatccgcctntggtnttcctggtcncttctctggctcctaagtctcggacaccgtccggccctaccctgacccatccgcggggtcncccgaggccgtggacggacgtacggacttaaccgtttattattcgtacttactttacaattaacgaacgaacgacccaaaccgaaacgtacgtacgttacgggttacggttaccgggacggggtaaacgggtaccgtaaacgggttaccgaacccggttcccgtaccggggtaaccaccggtaaccccgaacggtcccgtacccgtacccccccgtcgggttacccc

SEQ ID NO: 311862 - DNA, 657 bp, Homo sapiens
  misc_feature: GZ8MTXP02F4E02.25.36.D03.1.454.CMB.2.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (263)..(264): a, c, t, g, unknown or other
  misc_feature (263)..(264): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggnagcggtctcntctcttgtcgnggncngctcgacgtagtaatagttntctactgacnncacgcctaccgacgaaccgcccagcctctacatctagtagatgactcgacgccgcctagaccggtactaccgtcgaccgtcttctcgtcggtactacggtacgtcgtcggtccctccgtccgtccctcccgtcggtaccctagtccggtagggtccggtcccgttcccggggtacggaacggtacgtagggtacggtacgttaaggtaaacgttacgtttacggtagggttcgtacggttagggtttacgggacgtcggtaccgtaggttcgttagggtacgggttccggggttaccgggtacggggtttcgggtacgggggaccggggtaacggaccgtacggtccgttaccggaccggttaccgtacggtaccgaccggtaccggtaacgg

SEQ ID NO: 311863 - DNA, 682 bp, Homo sapiens
  misc_feature: GZ8MTXP02IXRI2.25.36.D03.1.454.CMB.2.raw
  modified_base (241)..(241): a, c, t, g, unknown or other
  misc_feature (241)..(241): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcggggacccccggaggacgggtcctccattctcttgttcgtgggancagtctcctacggtacggaaattaagtttgtctagtcggtaccagcacgcctacccaacggaacccggcccccaaagtcctccctcactctaacgtaggaatgtatcgacgccggccctcgaacgggtactaccgtacgacccgtattccgtcgtcggtcctacggtaacgttccgtcgggtcccttcccgtcccgggtcccccttcccgttcgggaccctagtccggtacgggtccgggcccgttaccccggggtaccggaggtacgtacgggtacgggtcttaaggtaatttagttaccgttggtaacgtcgttaagggtttcggatcggtaccgtaggtcgtaggtacgggttacggtacggtacggggttcgggtacggggacggaacgggaccaacgtcgtacggtaccgtacggtacgccgacggaccgtaccgg

SEQ ID NO: 311864 - DNA, 684 bp, Homo sapiens
  misc_feature: GZ8MTXP02G4ANM.25.36.D03.1.454.CMB.2.raw
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcacatctctgcactgaaccagaagtgatcgttggtgtcttangacactgtctctgccacctacgtttaccccaaggtaaaccnccccgaagacgtcacttccttangtactgtacgaggtaacgccggtacccgtacggtacccggggtccctagtacgtccgtcttcgtcgtcggggttacctaaaagtccgtacggaacctaacgacccgggtcccttacccgtacgtaaccctaacgttccgtccggttaccgggtacctaccccggtaaggtcccgtagggaacgtaacggttaggaaacggtcgttaagttaagtttacgtttaagttcgtaccgtttaggttaacctaagttaacgttcgaacgtaggtaaccttaaacgttacgttaaggtttcggtacggttccggacgtacgaacggtacgtaaggttcgaacccggtcggtaccgggtacaccgtaccgtaacccggg

SEQ ID NO: 311865 - DNA, 721 bp, Homo sapiens
  misc_feature: GZ8MTXP02GFPX2.25.36.D03.1.454.CMB.2.raw
  modified_base (190)..(190): a, c, t, g, unknown or other
  misc_feature (190)..(190): n is a, c, g, or t
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcgagggtcctgggcccagtctgtgctgactcacgcccaccctnagtgtcgtccgggaccccggnaggacggtctccatcttcttgtcgtggancagcctacgacgtacggaaattagttgtctacgtcggtaccagcacgtcccacccgaaacggaaccccggacccccaagtcctacctacactactagtaagatcgactcgacgccgccctagaccggtactaccgacgaccgttattccgtacgtcggtacctacggtaagttccgtcggtccctccgtccgtccctacccgtcgacctactcggaggtcggcccgtccggtaccggagacgtggacggtacgtagtaacgtttattacgtgggttacgtacggtttaagggtttggggtactccggtaaccgttagggttcggtacgggttaccgggtttcccggggttaacggggttccggggtttaccgggggttacgggggaccggggttaaaccggggaacccgtaacggtcccggttacccgggttaaccggttaccggttaccggtaccggaccccggaaccgggtaccccggg

SEQ ID NO: 311866 - DNA, 653 bp, Homo sapiens
  misc_feature: GZ8MTXP02HNI80.25.36.D03.1.454.CMB.2.raw
tcagactgtacagtcacgaccggtgctcgatttagctgcgtcacgatctctcttgggggggtctcaggaggcagcactctcgggacgtctccaccatggcctgggctctgctcctcctcagcctcctcactcagggcacaggatcccgggctcagtctgccctgactcagcctcgctcagtcgtccggtctccgtggacagtcagtcaccatctctgcactggaaccagaagtgattcgttaggtgacttatgactactgtctccgtggcctaccgtacgtttaacccgaaggaaaccgcccccgaagtacgtcctactttacctttatgtactgtacgaagggtaacgcccggtcccgtacggacccggggtccctagtctccgtcttccgtcgtcgggtacctaaagtccgtcggaccaaccgccggtccctcctacgaccctagtccgtcgtcggactccgagtcgtaggagtacgtaggtacgtcgttaggttatttagtttagttgtcgtttagttactattagtcgtacgtaggtaaccttaaacgttacgtttaggtttcgggttacggtttccgggacgtacggtaaccggtaacgtaacggttcgtacccggttcggtacggtaccgacggtacccggtaccgg

SEQ ID NO: 311867 - DNA, 588 bp, Homo sapiens
  misc_feature: GZ8MTXP02J00KW.25.36.D03.1.454.CMB.2.raw
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (306)..(306): a, c, t, g, unknown or other
  misc_feature (306)..(306): n is a, c, g, or t
  modified_base (354)..(354): a, c, t, g, unknown or other
  misc_feature (354)..(354): n is a, c, g, or t
  modified_base (461)..(461): a, c, t, g, unknown or other
  misc_feature (461)..(461): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctcagtgtctcgggacccccggaggaggtcctccatctcttgttcnggancagctccgacgtcgaaatagttgctatcggtaccagcagcctaccaagaaccggcccccaaagcctcctanatctataggatgatcgagccggccctagacggactaccgcgaaccgtntcgctggcctacgtagtctcggcctcgtcccggccctcccgtaggcctactcgagtcggggcctcccggtcgaacggtgtacgacggtctaagtaattacgttacgnggtagtccgttaagggtttcgggaactcggtaccctaggtccgtggtacgtcgggtaccggtacgggtcgttccggggacggacggtaccaaggtcgtaccgacgtccgtaagccgacgaccgacgg

SEQ ID NO: 311868 - DNA, 619 bp, Homo sapiens
  misc_feature: GZ8MTXP02JC54I.25.36.D03.1.454.CMB.2.raw
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgtttatttttccaggtgtccagagtgaggtgctaggttggtggagtcgtgggggagtcttggtccagccgtgggagggtccgtgagagtctctgtgcagcctntggattcattcttcagtcgaccatacntggacgtgggtcccncgagggtcctaccggaggggaacgggctggggagtggggttgaccccgttagtaagaaaataaagctaaaagtacgttaccaaccagaagtaactaccgcccgtacgtctagtagaaacggcaagtattactattactctaagaaaggatatagaattacaaaagtactacattgtaatcctagacaataagaacgaacgacgaacgaaaaccgaacggaacgaccggtaccggtacgttaacgttaaccgttacgtaagtacgtacggtacgtaacgtacggtaccggtacggttaacccg

SEQ ID NO: 311869 - DNA, 626 bp, Homo sapiens
  misc_feature: GZ8MTXP02HISNE.25.36.D03.1.454.CMB.2.raw
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
  modified_base (314)..(314): a, c, t, g, unknown or other
  misc_feature (314)..(314): n is a, c, g, or t
  modified_base (358)..(358): a, c, t, g, unknown or other
  misc_feature (358)..(358): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccacctcagtgtctcgggaccccggnagagggtctccatctcttgttctggancagctccgagtcggaaattaagttgtctactggtaccagcacgcctacccaacgaaaccggcccccaagcctcctcatctanaggaatgatcagccgcctgacggactaccgtgaccgtatttccncgtcggcttacgacgtcgtcggcctcccgtccgggccctcccgtcggcccagtcgaggttcggcctccgggtccgaggacgtggacggacttaggaactttagttacgtggtagccgttaagggtttcgggattcggcccgtagttccgtgggtaacgggtcggggttacccggtacggggttcgggttcggggaccggggttacggaccctaacggtccgtacggtacccgttacggtacggtaccgaccggtacccggaacccggg

SEQ ID NO: 311870 - DNA, 658 bp, Homo sapiens
  misc_feature: GZ8MTXP02GSVAX.25.36.D03.1.454.CMB.2.raw
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
  modified_base (306)..(306): a, c, t, g, unknown or other
  misc_feature (306)..(306): n is a, c, g, or t
  modified_base (358)..(358): a, c, t, g, unknown or other
  misc_feature (358)..(358): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggaccccggnaggagggtctccatctcttgttctgggancagctcgacgtacggaaattagttgtctactggtaccagcagcctaccaagaaccggccccaagcctcctnatgtatgggaatgactcacgccgcccctcgacggggtccctgaccgtattcnctcgccctccacgtctcggcctacctcacgtccctccgcggcccagtcccggtggccctaccaacgttcgaggaggacgttacgggacggtaccgttaattttacttagtttcgggacgaccgtagggtcgggttagggattacggaaaccgtaaaggggtaaaaccggttaaacgggtttatacggtttaccggttacggggttaaacgtttccggggaaaaccgtacggttacccgaaccggtttccgttaacgggtaccaccggtacccccggaaaaccggacccctaaaacccccg

SEQ ID NO: 311871 - DNA, 644 bp, Homo sapiens
  misc_feature: GZ8MTXP02HS7GE.25.36.D03.1.454.CMB.2.raw
  modified_base (207)..(207): a, c, t, g, unknown or other
  misc_feature (207)..(207): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnaggaggtctccatctcttgtctgggagcagctccgacgtcggaaatagttgtctacgtggtaccagcagcctcccaagaaaccggcccccaaagcctccctcatctagtacggaatgatcagccgccctgacgggatacccgtgaccgtattcctctggcttacgaagtccgtggcctcccgtcccggccctcccgtacggcccacgtcgacggtttcggggcccgttacccgggtccggagggtacgtggaacgggtcttaggtaaactttacgttacttggtcgtcgtagggttttgggacgtcggacccgaggttccgtaggtacggttcggggtacccggtaacggggttcgggtttacggggccgggaacggggtaccccgtaaaggtccgtacggacccggttccgtaagggtccacggaccccgtaacgg

SEQ ID NO: 311872 - DNA, 692 bp, Homo sapiens
  misc_feature: GZ8MTXP02HA3HK.25.36.D03.1.454.CMB.2.raw
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggatcccgggctcagtctgccctgactcagcctcgctcagtgtccgggtctcctggacagtcagtcaccatctcctgcactggaaccagaagtgatcttggtgcttatgacactgtctccgtcggccaccgtacgtttaacccaaggaaaaccgcccccaaggacgtctaacttcctttaatcgtatgtacgtaggaaacgccggtcccgtcgaccggggtccctgactcgtcttcgtacgtcggggtacctaaacgtccgtaggacctaaacgacccgggtccccttccccgtcgtacccctacgttccgtccggtcgggtcccttcccgaggtccgtagggaggacttagggagtcgtagttaatttatttagttcgtccgttgtttactaattgttacggacgtaacgggtaaccttaaaaccgttacgtttaaggtttttacggggttacggtttaccggggccggtaacggtacgggggtaaaccctaacgggtttccggtaacccggttccgggtcgggttaccgaccggtacccggtaaccggg

SEQ ID NO: 311873 - DNA, 701 bp, Homo sapiens
  misc_feature: GZ8MTXP02FF9HW.25.36.D03.1.454.CMB.2.raw
  modified_base (239)..(239): a, c, t, g, unknown or other
  misc_feature (239)..(239): n is a, c, g, or t
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtgctgactcagccaccctcagtgtctggggaccccccgggcaggagggtctccatctcttgttctgggancagctccgacgtcggaaatagttgtctactggtaccagcagcctccagaaccgccccaagctcctnatctataggaatgatcagcggccctanacgggactaccgtgaccgattcctctcggctacgaagttcgtcggtccttcccgtccgggcccttcccgtcggccctaagtccgaagggttcggggccttccccggggtacccggagggacttggaaacgggccttggtaaaacttacgtttaacgttggtacgtacgttagggtttagggggattcggcccgtaaggtcgtaggtaacgggttccgggttcccgggtaacggggtttcgggtttcccgggggaacgggggttaacgggggaacccccgtaaaagggggtccccgttaacggggttacccccggttacccggttaacggggttaccccgaaaaccgggtccccccgggtaaaaccgggg

SEQ ID NO: 311874 - DNA, 759 bp, Homo sapiens
  misc_feature: GZ8MTXP02HQV04.25.36.D03.1.454.CMB.2.raw
  modified_base (179)..(179): a, c, t, g, unknown or other
  misc_feature (179)..(179): n is a, c, g, or t
  modified_base (234)..(234): a, c, t, g, unknown or other
  misc_feature (234)..(234): n is a, c, g, or t
  modified_base (283)..(283): a, c, t, g, unknown or other
  misc_feature (283)..(283): n is a, c, g, or t
  modified_base (313)..(313): a, c, t, g, unknown or other
  misc_feature (313)..(313): n is a, c, g, or t
tcagactgtacagtcacgaccggtgctcgatttagctgcgtcacgatctctcttggggtgtgggctcagaagcagagttctggggtgtctccaccatggcctggacccctctctggctcactctcctcactctttgcataggttctgtggttttcttctgaactgactcaggaccccgntgtgtctgtggccttgggacagacagtcaggatcacatgccaaggagacagcctnagaacttatatgcatcctggtaccagcaagaagccggacaggccccctntacttgtccttacgtacggtacgaaaaccnccccgcccctagaagggacttcctccgaacgacccgtatttcccgtcgtcgggccttccccgccttacgaacgggtaaacctaccgtaacggtcccttttaccccgttaggaaaccccctaatttcccgaaacccggtttcggggggcccttacccggaaacggggtcccgaacccgaaaaggtaaccgttagggaaacggggccgttacgggtaaacctttaaacgtttaccgttaccggtttacccccgttacccccgggggaacctaccccgtaagggttacggtaaacggtccggtaaggggtttcggttacgggttaccggtttcggggacggggtaacggggtaccgtaaacgggtaccggtacccgttaccggtacggtaccgacgaccccgaaagggcccgtccgacccccgtcggtaccgaccgttccgttccccgg

SEQ ID NO: 311875 - DNA, 594 bp, Homo sapiens
  misc_feature: GZ8MTXP02F9KQW.25.36.D03.1.454.CMB.2.raw
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttatactggagctggatccgcagtccgccgggagggactggagtggattgggctatatatacgaatggattaaccacctacaacccctcctanaagntcgatcaccatatcagccgacacgtccagggatcgaggtcttcctgctatcctgtaccttcgtgccgactggcccgcggaccaccggccctatacctacgtgtcgccaaggacgtacgttcgggactggacgtacgtagttttacggagtaattattattcttgttgtctttgactagtggtgggaccgaagggacgacggtcgacgtctacttcacgcctaccaccgaacgggcccctacgtccgttcccttcccccgtcggaccctaccccgtccctacccgaaacgccgacccgtaccgtccggtacggggaccaccggacggccccggg

SEQ ID NO: 311876 - DNA, 597 bp, Homo sapiens
  misc_feature: GZ8MTXP02FU4X3.25.36.D03.1.454.CMB.2.raw
  modified_base (242)..(242): a, c, t, g, unknown or other
  misc_feature (242)..(242): n is a, c, g, or t
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
  modified_base (387)..(387): a, c, t, g, unknown or other
  misc_feature (387)..(387): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgacattggtncttataactatgtctcctggtcccaacaaccacccaggcaacggcccccaaactcatcatttatnatgtcagtcatccggccctntggtagtttcctggtccgtctttctctacggctccgaagtcgtgccaacctcgcctcccngaccatcgtcgggctccgaggctgacggacgagtcttacgttatattcgctatttcaataccgagagacctaacaactagtccgttagggttcggttacgggagggtaacgggtaactaaacgggttcgtaaccccggttccgtaccggttaaccgaaccggacccgaaaaccggggtcctacccgggtccccccgttacgggttacccc

SEQ ID NO: 311877 - DNA, 535 bp, Homo sapiens
  misc_feature: GZ8MTXP02H2VE3.25.36.D03.1.454.CMB.2.raw
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (313)..(314): a, c, t, g, unknown or other
  misc_feature (313)..(314): n is a, c, g, or t
  modified_base (431)..(431): a, c, t, g, unknown or other
  misc_feature (431)..(431): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctctcactcagggcacagggtcctgggccagtctgccctgactcagcctgccttcgtgtctgggactccgtggacagtcggtcaccatctctgcaactggaaccagccgtagatattgggtntacttaanaactntctctcctacgaccaaacaaccacagacaaccgacccaancatntattangatnnatacactcgcctcgtgtgtcgtgtcgtctctctgctctacgtctcgacacgtcgcctcctacacacgtcgtcggcgcgacgacgagaggacgtagtacttattattatatatattanatagagacaacaacaactagtagtggtacggtacggacggaacggaacgtaacgtacgtacgtaccgtacgtaacgacgacgacgacgtccgtccgtacgtacg

SEQ ID NO: 311878 - DNA, 660 bp, Homo sapiens
  misc_feature: GZ8MTXP02GU0B0.25.36.D03.1.454.CMB.2.raw
  modified_base (313)..(313): a, c, t, g, unknown or other
  misc_feature (313)..(313): n is a, c, g, or t
  modified_base (370)..(370): a, c, t, g, unknown or other
  misc_feature (370)..(370): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgcttcttttaagaggttgtccactgtcaggtgcactggtggagtcgtgggggagcgtggtccagccgtgggaggtccctgagctctctgtgaagcctctggtatttagtttcagttggttctggcatgcacgtggggtcccnccgaggcctccgagggacgaacggggggccggtagttggggttggactaaggtttanacggcaacgtagttcggaagttcggggtaaagtttctaaggtaaaatttattaagtcgacgtaagtaccgtccggtaggaaacggggtcccgtaatttacccaaccctaattcccgtaaccgaagaacggtaaacctaaacgtttacccgggaaacttagtttcggtattaacgttagggaaattcggtacaagcctagacgagtacgaggtactcggcttacgtagtaactttacgtggtaaggtacgaaggtacggtacgggggtaggttacggttaagtttaacggg

SEQ ID NO: 311879 - DNA, 676 bp, Homo sapiens
  misc_feature: GZ8MTXP02HFQF3.25.36.D03.1.454.CMB.2.raw
  modified_base (338)..(338): a, c, t, g, unknown or other
  misc_feature (338)..(338): n is a, c, g, or t
tcagactgtacagtcacgaccggtgctcgatttagctgcgtcacgatctctcttggggggggtctcaggaggcagcactctcgggacgtctccaccatggcctgggctctgctcctcctcagcctcctcactcagggcacaggactcccgggctcagtctgccctgactcacgcctcgctcagtcgtccgggtctccgtggacagtcagtcaccatcctcctgctacgtggaaccagtaagtgattcgttggtgtcttatgactactgtctcctggtacctaccgtacgtttaaccccgaaggtaaaccgccccaagtacgtcctacgttcctttagngtactcggtcgacggaacggtccgtaccccgtacggaccccggggttaccctgtaaccgtccgttcgtttccgttacgttccggggtaacctaaacggtccgttacggaccctaaaccgtacccggtccctacccgtacgtaccctacgttcgtcgtacgtccgtcgacggtccgtagggacgtagttacggacgtaccgtagttaactttacgttacgttgttaccgttcgttactacgttaagtcgacgtaacgtactaacgttacgttgtttcgggtgtaaccggtcgacggtacgtaacgtaaggtaccgacgtccggtgtacgcgaaccgtcg

SEQ ID NO: 311880 - DNA, 564 bp, Homo sapiens
  misc_feature: GZ8MTXP02HGAMS.25.36.D03.1.454.CMB.2.raw
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccaggtccgccggggaggggactgggagtggattgggcgtatatatacgaatggaattaaccacctacaacccctcctanaagngtcgatcaaccatancagcggacacgtccagggatcgaggtntccngcatctgacttngcgatgccgcggacaccggcccttaatactactgtcaccaggacgattcggactggacgtacgtagttttcggagtaattattattctttgttgtcttttagactagtggtcgggtacgagggacgacgtccacgtctacttcacgcctccacgacggccctacgtccgttccgtccccgtcggacctacccgtccctaccaacgcgacctaccgtcgtcggggacacgacgcccgg

SEQ ID NO: 311881 - DNA, 653 bp, Homo sapiens
  misc_feature: GZ8MTXP02JFXYR.25.36.D03.1.454.CMB.2.raw
  modified_base (180)..(180): a, c, t, g, unknown or other
  misc_feature (180)..(180): n is a, c, g, or t
  modified_base (185)..(185): a, c, t, g, unknown or other
  misc_feature (185)..(185): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (404)..(404): a, c, t, g, unknown or other
  misc_feature (404)..(404): n is a, c, g, or t
  modified_base (573)..(573): a, c, t, g, unknown or other
  misc_feature (573)..(573): n is a, c, g, or t
tcagactgtacagtcacgaccggtgctcgatttagctgcgtcacgatctctcttggggtgtgggctcagaagcagagttctggggtgtctccaccatggcctggaccccctctctggctcactctcctcactctttgcattaggttctgtggtttcttctgaactgactcacggaccccntggtntctgtggccttgggacagacagtcaggactcaacatcgaccaagganacagcctanaagtaacttntaangcatccnggtacagcacgaacggccggacaccggtcccctcttactcgtcttacgtaacggtacaaaacccgccccgccctacgaggtactccgtacgaacgaccgtacttcccgtcgtcggtcctcccgtaccgtacgaaacggaacncgtaaccggttcctttaccgttaccgaacctaacgtccgtaacggttcggggccttacggaacggccgaacgaaaggacttaggacggtacctagtaactttacgtttaccgttaccggttccccggtaccggaacctaacgtacggttaagaccgtaggtacggttgnggtttacgcggaggacgacggtagcggactcgacgtcgacgaccgtaagcctacgcccgtacgtcacccgttcgtccccg

SEQ ID NO: 311882 - DNA, 599 bp, Homo sapiens
  misc_feature: GZ8MTXP02HG227.25.36.D03.1.454.CMB.2.raw
  modified_base (260)..(260): a, c, t, g, unknown or other
  misc_feature (260)..(260): n is a, c, g, or t
  modified_base (329)..(329): a, c, t, g, unknown or other
  misc_feature (329)..(329): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (524)..(524): a, c, t, g, unknown or other
  misc_feature (524)..(524): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagtctgggttttccttgttgttatttttccgaggttgtctagagtggaggtgctaggttggtggagtcggtgggggagtcgttggtccaggtcctgggacggtccgngagtgtctccgtgtgcagtccctgtggtacttcatcttcagtcgacccatacagtggactcgggtcccncgagccgtacggaggggagggctggagtgggttgcccgtatagaaataagntaagactacactaanaganccgcgntcngtagacgnagtattcgattatacagaaagagattagattaaacgaaagtaacctcgtactagttactcgtagaaactaacgtagaaaccgtaagacccgtaaaaggaaaacccggngaacccgtcgggtactacgttacgttactggtaagtaccgttaggacgacgtacggttacggaccttaaaccccg

SEQ ID NO: 311883 - DNA, 766 bp, Homo sapiens
  misc_feature: GZ8MTXP02FKMSE.25.36.D03.1.454.CMB.2.raw
  modified_base (210)..(210): a, c, t, g, unknown or other
  misc_feature (210)..(210): n is a, c, g, or t
  modified_base (320)..(320): a, c, t, g, unknown or other
  misc_feature (320)..(320): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcggggacccccgggnaggacgggtctccatctcttgttctgggagcagcctccgacgtacggtaaattaagttgtctactggtaccagcacgcctacccaagaaacccggcccccaaagcctccncagtctagtagaatgatcagcgccctagacgggtactaccgtgaccgtattcctcgtgggacctacggtaaacgttccgtcgggtccttccccgtcccgggtccccttaccccgtcgggaccccctaagtccgtaacgggttcgggggtccccgttcccgggggtaccgaagggtacgttgggaaacgggtcctaaaggttaaaaccttagtttaccgttgggtaggtaccgtttaaggggttttcgggggaatttcggggaccctaacggttttacggggtacgggtaaccggggtttccggggtacccggggttacgggggtttacccgggggttaccgggggaaacgggggtaaccgggtaacccggtaacgggtcccgttaacccgggttaacccggttacccggtaaccgggtaacccgtacccggaacccccggtaacgg

SEQ ID NO: 311884 - DNA, 540 bp, Homo sapiens
  misc_feature: GZ8MTXP02IEYNA.25.36.D03.1.454.CMB.2.raw
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (299)..(299): a, c, t, g, unknown or other
  misc_feature (299)..(299): n is a, c, g, or t
  modified_base (322)..(322): a, c, t, g, unknown or other
  misc_feature (322)..(322): n is a, c, g, or t
  modified_base (447)..(447): a, c, t, g, unknown or other
  misc_feature (447)..(447): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccggnagaggtctccatctcttgttctggancagctccgacgtcgaaatagttgtctactggtacagcagctccaagaaaccggcccccaagctccncatctatagatgatcagcgcctnacggatacctgaccgattctctgctcgaagtcgtggcctcctccggccctccgcgccatccgagtcgggcctccggtccgaggatggagtctaggaattacttagtcgtgccgttaggttagggntcgcctagtcgtgtacggtggtcccgaggtcggttaccgggcgggacggaccgtaagcgtacggacccgtacgtaggccaacggacccgacgg

SEQ ID NO: 311885 - DNA, 591 bp, Homo sapiens
  misc_feature: GZ8MTXP02IAR35.25.36.D03.1.454.CMB.2.raw
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (276)..(276): a, c, t, g, unknown or other
  misc_feature (276)..(276): n is a, c, g, or t
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (443)..(443): a, c, t, g, unknown or other
  misc_feature (443)..(443): n is a, c, g, or t
tcagactgtacagtcacgaccggtgctcgatttagctgcgtcacgatctctcttggggagcttcagctgtggtagagaagacaggattcaggacaatctccagcatggcccggcctccctctcctcctcaccctcctcactcactgtgcagggtcctgggcccagtctgtgctgactcagcccaccctcagtgtcctcgggaccccccgggnaggacgggtctccatctnttgtctgggancagcctccggacgtacggaaattaagttgctacgnggtaaccagcagcctacccgaacgaaacccggcccccaagcctccncatctanaaggatgatcagccgcctgacggactaccgngaaccgtnttcncgtgctagacgtctgcctcgtcccggcccttccgaggccngtacgngtcgggccgtcccggtacgagggtntggacggtactaggtaactttagttacgtgtcgacgttaggtttgggactcgacctgtcgaggtcggttggtccggacggttcgggtaccgggcggaaacgggaccaagggcttcggaacccgttcggacgtcgaaccgtcccgacgg

SEQ ID NO: 311886 - DNA, 779 bp, Homo sapiens
  misc_feature: GZ8MTXP02G595E.25.36.D03.1.454.CMB.2.raw
  modified_base (211)..(211): a, c, t, g, unknown or other
  misc_feature (211)..(211): n is a, c, g, or t
tcagactgtacagtcacgaccggtgctcgatttagctgcgtcacgatctctcttggggagcttcagctgtgggtagagaagacaggactcaggacaatctccagcatggccagcttccctctcctcctcaccctcctcactcactgtgcagggtcctgggcccagtctgtgctgtctcagcccacctcagtgtccgtcgggggcccccggnaggacgggtcgacattctcttgttctaggaacgtcgcctaccgaaacgtcgaactaagtaataggtagtaacgctacggtaaccagaccaacctccccgaagggaaccccgcccccaacacctccctacagttgtaagtaggggaaatggactaccgacggccccgtaccccgtaccgggtacccggggtcccctacgggaacccgttctttccgtcctaccggtccccttacccgtacgttccgtcgggaccctacccgtccgtaccgtccctccccggtcggacccttcggtcccgggtacggtccctaccgtaacttccggtaggagggaaagtcgggtaaacggtaccgtttatttaacgtttggttacgccgaggtacgggtacggtgggaaccgtaggtaaacggaaacgggttaaaacggtaaggtttcgttacggtttaaccggttaacgggttaaacggtttaccggggaaacccgttaaccggggtaaccgttaaccccggttaaccggttaacggtacccgaaccccgggaaccccgtaaccggtaaaacccccccg

SEQ ID NO: 311887 - DNA, 598 bp, Homo sapiens
  misc_feature: GZ8MTXP02F0XNP.25.36.D03.1.454.CMB.2.raw
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (419)..(419): a, c, t, g, unknown or other
  misc_feature (419)..(419): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtgctgactcagccaccctcagtgtctcgggaccccggnaggaggtctcatctcttgtctggancagctcgacgtcggaattagttgctactggtaccagctagcctaccgaagaaccggcccccaagcctcctnatctaagtacggatgatacgagccggccctgacggggtactacccgngacccgtattccgtcgttcggactcggtaaacgtccgtgggtcccttcccggtccggtcccttccccgnggtaccctagtccgtaacggggttcgggcccgttaccgggtccggaaggacgtgaggtacgtagtaagttaagttacgtgtgtacgtaggttggtgtgcgtagtcgtgtagtcggtcggtcggtcggttcggcggacggaccgacgcgtacgacgtaccgtacggacgacgacgaccgg

SEQ ID NO: 311888 - DNA, 659 bp, Homo sapiens
  misc_feature: GZ8MTXP02IQZ3N.25.36.D03.1.454.CMB.2.raw
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
  modified_base (307)..(307): a, c, t, g, unknown or other
  misc_feature (307)..(307): n is a, c, g, or t
  modified_base (328)..(328): a, c, t, g, unknown or other
  misc_feature (328)..(328): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtntctgggactcctggacngtcgtcaccntctcctgcactggaaccagccgtgacattggtncttataactatgtctcctggtcccaacaacacccaggccaacggcccccaaatcactatattanatatcacatcacgtccgctgngttagtcgtcgtctacttctcgtcgtcctcgtacgtcgtacgtaaccgtccgtccgtccctccgtaccgactccgtccggtccggtcctcggacgtcggagggacgggtacggtacgtacctttaagtttacgtttacgtacgtactttaccgtttaacactaaacggtacgaacctacccgaaaaccgtacgttaacgtcggtacgggtttaccggggcggggtaacgggggtaccggtaaacgttaccggtccgttaaaccccggtccggttaccgaacgtaccgggtacccgacggtccccgtcccccgtcccgggttaccgttcccg

SEQ ID NO: 311889 - DNA, 726 bp, Homo sapiens
  misc_feature: GZ8MTXP02IIVMF.25.36.D03.1.454.CMB.2.raw
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtagactattggtgtacttataactatgtctcctggtacccaacaacacccaggacaacggacccccaaactcatcatttacnatgtacagtcagtcgtccctntggtactttccgaggttccgtctttctctcggcttccgtaagttcgtcggtaccaaaccttccgggacccttccccgtacgaccctactccgtcgggcccttaccgacggccgttaggaacgggaccggtaagggacctttaaagtttaaaccgtttagtttacggttacttacttttaccaaacgtttaacgaaacggttaaacggaacctaaaccccgtaaaacgtacgtttaccgtaacgggggtttacgggtttaccgggacggggtaaacgggtaacccggtaaaggtttccgggaaacccggtttccgtaccgggttaacccgacggtaacccccggtaaacggtacccgttcccggtaacccccggttcgggtttaacccccg

SEQ ID NO: 311890 - DNA, 563 bp, Homo sapiens
  misc_feature: GZ8MTXP02GNA7Y.25.36.D03.1.454.CMB.2.raw
  modified_base (292)..(292): a, c, t, g, unknown or other
  misc_feature (292)..(292): n is a, c, g, or t
  modified_base (453)..(453): a, c, t, g, unknown or other
  misc_feature (453)..(453): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacaccagcaacgcccccaancatcattatgatgtcagtcatcggccctctggtagtttcctggtctcttctctggctccaagtctgcaactcggcctccctgaccatcgtcggggctccgaggctaggacggacgaggtctactttattattcgctatttcatacagacgtacaacaacgngtacgtggttcgttacgggcgggacgggtaccgtaaacggttccgaaccgttccgtccgggtaaccgtacgacccgtaacggcccgtccggtcccccgttcggtaccccg

SEQ ID NO: 311891 - DNA, 721 bp, Homo sapiens
  misc_feature: GZ8MTXP02H4G98.25.36.D03.1.454.CMB.2.raw
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctcgtgtctgggactccgtggacagtcggcaccatctctgcacgtggaaccagccgtgactattggnacttataactatgtcncctcgtacccaacaacaccagcaacgcccccaaatcatcattacngatgtcngtcagtcgtccctgtggtagttccgtcggtcgtcttctccgttcggtcctccgtaaacggttctaccggggtacctaaacccgttcccgggacccttcccgtaaccgacccgtacgttcccggtcgggggtcccttacccggaacggtcccggtagggaacggtaccggtacgggttacttaacggtttatttaaacgttcggtaacttaactttaactaacgttaacgaacggtaacgtaaacccgtaaaccaaaccgtaagtttccgttaaggggtttccgggttaaccgggtacgggggaaccggtaaaccgtaaagggtttccgaaccccggttccgtacccggttaaccgacggtaaccccgtacggggccctttacccccggcccccgtttaacggtacccccg

SEQ ID NO: 311892 - DNA, 646 bp, Homo sapiens
  misc_feature: GZ8MTXP02IY0HD.25.36.D03.1.454.CMB.2.raw
  modified_base (213)..(213): a, c, t, g, unknown or other
  misc_feature (213)..(213): n is a, c, g, or t
  modified_base (247)..(247): a, c, t, g, unknown or other
  misc_feature (247)..(247): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtcgtcgtccggggacccccggnaggacggtcctccattcttcttgttcgtgggacncgacgtccgtccgacggtacggtaaattaggtttcgtcttacgtcggtaccagcacgtcctaccccgaaacgaaccccggtcccccaagtccctacctacacttactaagtaacggaatgatcgacgccggacctacgacggtaacctaccgtacgaccgtattcctcgtgggcctacggtacgttccgcggcccttaccgtcccgcccttacccgcggaccctagttcggacgggttcggcccgttccggacgaggcgtagaggtctaggaaactttgtacgtggtcgtcgttagggtttacggatcggctaggtcgtaggtcggtcggtacggtcggtggtccggacgggaacgcagccgttacgaccggtacgtacggaccacggacccgtaacgg

SEQ ID NO: 311893 - DNA, 598 bp, Homo sapiens
  misc_feature: GZ8MTXP02F6C8U.25.36.D03.1.454.CMB.2.raw
  modified_base (268)..(268): a, c, t, g, unknown or other
  misc_feature (268)..(268): n is a, c, g, or t
  modified_base (308)..(308): a, c, t, g, unknown or other
  misc_feature (308)..(308): n is a, c, g, or t
  modified_base (346)..(346): a, c, t, g, unknown or other
  misc_feature (346)..(346): n is a, c, g, or t
  modified_base (378)..(378): a, c, t, g, unknown or other
  misc_feature (378)..(378): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggaggtccctgagactctcctgtgaagcctntggtatttagttcagtggttctggcatgcacgtgggtccnccaggctcgagggcaaggggccgagtggtggcagttangcacatgatgggaattctagaaattacttagngacacgtacgtcggtaggaacggcgtataccactatccacgagacgaactaacgttacccggaactagttagtacgttaacgttaggtaaagtcggtacgacgtccgtaggaggtacggtacggacggtaccgtcggtacttacgttacgttacttacgtggtaacgtacggtaacggtacggggtacgggggtagggttacgggttaacggtttaacgg

SEQ ID NO: 311894 - DNA, 648 bp, Homo sapiens
  misc_feature: GZ8MTXP02IIMPP.25.36.D03.1.454.CMB.2.raw
  modified_base (213)..(213): a, c, t, g, unknown or other
  misc_feature (213)..(213): n is a, c, g, or t
  modified_base (376)..(376): a, c, t, g, unknown or other
  misc_feature (376)..(376): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctaaccctcctcactcactgtgcagggtcctcgggcccagtctgtgctgactcacgcccaccctcagtgtcgtcggggaccccccggnaggagggtcctccgtatcttcttgttcgtgggacgcagcctccgacgtacgtaaatagtttgctagtggtaccagcagcctaccgaacgaaacccggccccaagcctcccgtacatctaagtaaggatgaatcgacgccgcctagaggccttacgcgaacgtnttcgtcgtcggtctacgtactccgtacgtccctcgtaccgtcccctccgtgcctagtcggtaggtcccgggtcgttacccgggacgtaggaacgtgacggaccttaaggtaactttacgtttacgtggttacgtgtaacgggttgtagcgtaccgtgtcgtaggtcggttacgggtcggtacgggtcggttacccgggagggtaccggaaaccgtaggaccgttaacggtacccggtctaccggggtacaccgggtacctaacggtcccccg

SEQ ID NO: 311895 - DNA, 595 bp, Homo sapiens
  misc_feature: GZ8MTXP02ICFK0.25.36.D03.1.454.CMB.2.raw
  modified_base (370)..(370): a, c, t, g, unknown or other
  misc_feature (370)..(370): n is a, c, g, or t
  modified_base (491)..(491): a, c, t, g, unknown or other
  misc_feature (491)..(491): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccacccgtcggtgtctgaacgcccccaggcagagggtcaccatctctgttctggagcagctaccgaacgtcggagataatgactagtaactgtaccagcgacggtcccgaagggaacgcctacccaaactcctacatactattatgatgatctgcctccgtcccgtcgtacggggtctcgtcgtaccgtnttccgtcgttcggcctacgtagtctacgcctaccctcgccgtcccgtcccgtacggccctaagtccgtaggtcggtacctaccgacgtcgtaggacggtagtggaacgtcgtagtaacttnttacgtgtgcagtcgtaggtgacgtacgacgtacgtcgtaggttacggttgggggttggggttacgggttcgggggacgggtaccgggtaacgaacggtcccgg

SEQ ID NO: 311896 - DNA, 627 bp, Homo sapiens
  misc_feature: GZ8MTXP02FK6KU.25.36.D03.1.454.CMB.2.raw
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggaggtccctgagactctcctgtgaagcctctggtatttagtttcagtggttctggcatgcacgtgggtccgccaggctccgagggcgaagggggccggagtgggttggcagttatagcacatgatgggaagttctgaatattatgcagactccgtggaagggccgtagttcacctatcctaccagtacgaaacctaacgttaccccgggaaactagtttggtacggttaacgtttagggtaaaagttcgggttaccgaacggtcccgttagggaacggtacggttaccgggaacgggtaccgtccgggtccgttcgttaggttaacttacgtggttggaccggtaggaggttcgggggtaggggttacgggttaacggtttaaacgggg

SEQ ID NO: 311897 - DNA, 526 bp, Homo sapiens
  misc_feature: GZ8MTXP02FMKXD.25.36.D03.1.454.CMB.2.raw
  modified_base (327)..(327): a, c, t, g, unknown or other
  misc_feature (327)..(327): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgtcttataactatgtctcctggtcccaacaacacccaggcaacgacccccaaatcatcatttatgatgtacagtcatccgcctntggagtttctggtcgcttctctggctccaagtctggccaacctcggccctccctcgacctatcgtcgggctccgagctgacggcgaggcttacttattatcgctatttcaatacagtagacacaacgagtcgtggtcgttcgggcggacggacctagttcgaccgtcgtcggtcacgccaggtcctcgcccctacgtcc

SEQ ID NO: 311898 - DNA, 629 bp, Homo sapiens
  misc_feature: GZ8MTXP02IHWQD.25.36.D03.1.454.CMB.2.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (246)..(246): a, c, t, g, unknown or other
  misc_feature (246)..(246): n is a, c, g, or t
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
  modified_base (482)..(482): a, c, t, g, unknown or other
  misc_feature (482)..(482): n is a, c, g, or t
tcagactgtacagtcacgaccggtgctcgatttagctgcgtcacgatctctcttggggagcttcagctgtggtagagaagacaggattcaggacaatctccagcatggcccggcctccctctcctcctcaccctcctcactcactgtgcagggtcctgggcccagtctgtgctgactcacgcccaccctnagtcgtcgtccggggacccccggnaggacggtctccattcttcttgttcgtgggancagcctaccgacgtacggtaaattagttgtctacgtggtacagcacgcctaccgaacggaaacccggccccaagtcctcctacatactagtaagatgacncgacgccgcctacgacggtactaccgngtaccgtntttccncgtcggtactacggactccgtcgcctcctcccggcccttccgcgcctagtcgacggtcggcccgtccggacgaggctggacgtctagtaaatttntacgtgtcgtacgttaggtttacggcttcgaccgttaggtcggtacggttgggttccgggttaccgggtacgggtttcgggtaccgggcgggaaaacggtacacggtccgtcggtacccgtacgtacggccaaccggtaccgaccgg

SEQ ID NO: 311899 - DNA, 723 bp, Homo sapiens
  misc_feature: GZ8MTXP02GIXCS.25.36.D03.1.454.CMB.2.raw
  modified_base (188)..(188): a, c, t, g, unknown or other
  misc_feature (188)..(188): n is a, c, g, or t
  modified_base (241)..(241): a, c, t, g, unknown or other
  misc_feature (241)..(241): n is a, c, g, or t
  modified_base (278)..(278): a, c, t, g, unknown or other
  misc_feature (278)..(278): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctccaccctcctcactcactgtgcagggtcctgggcccagtctgtgctgactcagccaccctnagtgtcgtcggggacccccggcaggaggtcctccattctcttgttcgtgggancagccgtcgacgtacgaaattagttgctatggtaccngcacgcctacccgaacggaaaccccggcccccaaagtccctccctactactacgttaagtaagggaaatggacttacgacgccggccccgtaggaaccggggtacctacccgtcgaacccttactttccacggttccggtactacggtaacgttccgtcggtcccgttcccgtcccgggtcccttacccgttcggaccctagttcccggacgggttccggggtcccgttaccccgggttaccgggaaggtacgttcggacgggttacctaaggttaaactttacgtttaccgtgggtacgtacggttaaggtttgggacttcggacgtacgttcgtaggtcgggttcgggtaccgtacgggggttcggtaccgggacggggtaaccggtaaccacggtccgtacggtaccccgttacggtaacggccaaccgggcccgtaaccgg

SEQ ID NO: 311900 - DNA, 545 bp, Homo sapiens
  misc_feature: GZ8MTXP02FGMIN.25.36.D03.1.454.CMB.2.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctggggaccccccgggnaggagggtctccatctcttgttctgggancagctcgacgtcggaaatagttgtctactggtaccagcagctccagaaaccggccccaagcctcctcatcataggatgatcagcggcctcgacggggactacctgaccgtattcctcgtcggctcgaagtctggtctccgtcggccctcccgtcggccatcgaggtcgggcctccgggtccgaggagtcggaggctagtaactatactggncgtagttgggatgccagtcngtacgtcggtcggacggtcggttcgggcggacgggacaagcgtacgtacccgtcgtaggtaccgacgcccgaacgg

SEQ ID NO: 311901 - DNA, 621 bp, Homo sapiens
  misc_feature: GZ8MTXP02GJL5Q.25.36.D03.1.454.CMB.2.raw
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
  modified_base (522)..(522): a, c, t, g, unknown or other
  misc_feature (522)..(522): n is a, c, g, or t
  modified_base (577)..(577): a, c, t, g, unknown or other
  misc_feature (577)..(577): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcgttgggttttcctgtttgtttatttttccaggtgtccagagtgaggtgcagttgggtggagtcggtgggggagcttggccaggccgtgggagggtccgtgagagtctcgngtgcagcctcgngtattcatctacagtcacctatacngtcggacgtgggtcccncgagggcctaccgggaggggaggggctaggggaggttggggttcggaccccgttaagtaagaaaataacggtactaaagagttaccaccaaacgagtaaacgtccgacgtcgtcgtagtacgaaagcagtacttatattacgtctacgaagagtatagtaattaaccgaaaatacctatacgttataactctagaactaaancgaaacacgactaacggaaaacgcggaaccgtacggtcgttaacgtacttacgtntaacggtacgttaggtactaaggtaccgtacggtaccttaaccc

SEQ ID NO: 311902 - DNA, 735 bp, Homo sapiens
  misc_feature: GZ8MTXP02H6XZ8.25.36.D03.1.454.CMB.2.raw
  modified_base (211)..(211): a, c, t, g, unknown or other
  misc_feature (211)..(211): n is a, c, g, or t
  modified_base (243)..(243): a, c, t, g, unknown or other
  misc_feature (243)..(243): n is a, c, g, or t
  modified_base (283)..(283): a, c, t, g, unknown or other
  misc_feature (283)..(283): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (544)..(544): a, c, t, g, unknown or other
  misc_feature (544)..(544): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtccgtcggggacccccggnaggagggtcctccatctcgttgttcgtgggancagctccggagtacggaaattagttgactagtcggtaccngacagcctaccccgaacggaaaccccggcccccaaagtcctccctactaactacctaaagtaaggaattaggactacgaacggtccggccctaggacggtactaccgtcgaaccgtnttccncgttggccgttacgacggttcgtcgtccctccgttcccggacccccttccgtcggacccagtttaccgaggggttaacgggaccgttcccggggtacggaagggtcgtaggagggtccttaagtaaagtttagttacgngggtggtacgttaaggggttcgggtaatcggtaccgtaggttccgtagggtaacgggtcggggttacccgggtacgggtttcgggggtccgggaacgggggacccggtaaaccgtaacgggtcccggttaaccggggaaccccggtttacccggttaggggtaaccccgaaccgggtacccccggaacggg

SEQ ID NO: 311903 - DNA, 579 bp, Homo sapiens
  misc_feature: GZ8MTXP02H38E8.25.36.D03.1.454.CMB.2.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (420)..(420): a, c, t, g, unknown or other
  misc_feature (420)..(420): n is a, c, g, or t
tcagactgtacagtcacgaccggtgctcgatttagctgcgtcacgatctctcttggggagcttcagctgtggtagagaagacaggattcaggacaatctccagcatggcccggcctccctctcctcctcaccctcctcactcactgtgcagggtcctgggcccagtctgtgctgactcagccaccctcagtgtctcgggacccccgggnagaggtctccatctcttgtctgggancagctcccgagtacggaaataagttgctactggtaccagcagctccagaaccgcccccaagctcctcatctaataggaatgatcacgccggccctgacggactaccgtgaccgtattctctgggctaggacgtctgcctccgccgggcctcccgtggccctatcgagtgggcctccggtccgagntgaggctagtaattgttacgtggtgacgttaggtttgggatcggccgtagtccgtaggtcggtcggttccgggacgggttggttaccggggaccgggaagggacccctaaggtcccgtacggtaccccgtccggtaggtcccgaaccgtacccggacgg

SEQ ID NO: 311904 - DNA, 580 bp, Homo sapiens
  misc_feature: GZ8MTXP02FRRFV.25.36.D03.1.454.CMB.2.raw
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
  modified_base (462)..(462): a, c, t, g, unknown or other
  misc_feature (462)..(462): n is a, c, g, or t
tcagactgtacagtcacgaccggtgctcgatttagctgcgtcacgatctctcttggggagcttcagctgtggtagagaagacaggattcaggacaatctccagcatggcccggcctccctctcctcctcacccctcctcactcactgtgcagggtcctgggcccagtctgtgctgactcagccaccctcagtgtctcggggaccccccgggnaggagggtctccatctcttgttctgggancagctccgacgtacggaaataagttgtctactggtaccagcagctccccaagaaccggcccccaagcctcctcatctataggaatgatcacgcgccctgacgggactaccgtgaccgtattcctcgtggtctacggtaagtcgtcggctcccgtcggtccctcccgtggcccagtcgaggtcgggcctccgggtccggaggacgtggacggctagtaattnttacgtgtgacgtggtttgggattcgcctagtcgtggcggtcgggtccgtacgggtggttcgggacgggaacgggaccaagtcgtcggaaccgtccgtaggtacgacgaccgaaccgg

SEQ ID NO: 311905 - DNA, 551 bp, Homo sapiens
  misc_feature: GZ8MTXP02INHPL.25.36.D03.1.454.CMB.2.raw
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (269)..(269): a, c, t, g, unknown or other
  misc_feature (269)..(269): n is a, c, g, or t
  modified_base (469)..(469): a, c, t, g, unknown or other
  misc_feature (469)..(469): n is a, c, g, or t
  modified_base (532)..(532): a, c, t, g, unknown or other
  misc_feature (532)..(532): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgcttcttttaagaggtgtcccactgtcaggtncacctgggtggagtcgngggggagcgtggtccagccgtgggacgtccctgagctctctgtgagctntggtatttagtttcaggttggttcgtggcatgctacgtggggtcccgccgaggcctccgagggcgaaggggcccggtaggtggtggctagttatagcacatgagtggattcgtagtaatattagtgcagacgttccggtaggacgggccctattacaccattcctaccagacgaactaaacgtacccgaatacgttagtntacgttagaatgcagctagagtacgcgagtctcggtctcgtagttactgtgaagtgagtaggnggtaggtggtacgtttagg

SEQ ID NO: 311906 - DNA, 560 bp, Homo sapiens
  misc_feature: GZ8MTXP02HKNQC.25.36.D03.1.454.CMB.2.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
  modified_base (393)..(393): a, c, t, g, unknown or other
  misc_feature (393)..(393): n is a, c, g, or t
  modified_base (448)..(448): a, c, t, g, unknown or other
  misc_feature (448)..(448): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggaccccccggagagggtctccatctnttgttctgggancagctccgacgtcggaaatagttgtctatggtaccagcagcctccaagaaccgccccaagcctcncatctanaggaatgatcagcggccctcacgggactaccncgaccgtattctcgtggctacgaagtctggccctccgtcccggaccctcccgnggcccagtcgagtcggcccgttcggccgagagtgacggctaggaattacgttacnggtgctaggtttggattcgcctagtctggtacgttcggtccggtcggtggttacggcgggaacggtacccaaggtcgtacggtccgtacgtaggtccgaccgtacgaaccgg

SEQ ID NO: 311907 - DNA, 830 bp, Homo sapiens
  misc_feature: GZ8MTXP02GJ4IP.25.36.D03.1.454.CMB.2.raw
  modified_base (239)..(239): a, c, t, g, unknown or other
  misc_feature (239)..(239): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcggggacccccggaggacggtctccatcttcttgttcgtgggancagcctccgacggtacggaaattagtttcgtactactggtaccagcacgcctaccccgaagaaccccggcccccaagtccctacctataactcgtaagtacggaaatcgataccgacggccgaccccgttgaacccggggtactaacccgtcggaacccgttatttcccgtcgttcgggtacccttacgggtaaacgtttccgtaccgggttccccgttcccgttccccggggtacccccttcccccggttcggggacccccttaagttcccggtaaacgggggtttccgggggcccccggtttacccgggggtacccggaagggggttaacgtcggggtaaacggggttacctttaaacggggtaaatttttaccggtttaaccggttgggttacggtacccgtttaaagggggttttggggaaccttcgggttaacccgtagggttccgttaacggggtaagggtttcccgggggttaacccgggtaccggggtttgggggttacccggggacgggggtaacggaccctaaacggtccggtaacggtacccggtcccgtaagggccccaaccgggttacccaaccgggg

SEQ ID NO: 311908 - DNA, 665 bp, Homo sapiens
  misc_feature: GZ8MTXP02FGF4H.25.36.D03.1.454.CMB.2.raw
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (321)..(321): a, c, t, g, unknown or other
  misc_feature (321)..(321): n is a, c, g, or t
  modified_base (341)..(341): a, c, t, g, unknown or other
  misc_feature (341)..(341): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcggtcaccatcncctgcactggaaccagccgtgacagtttggngtcttaataactatgtccttcctggtaccccaacaaaccacccaggccaaacggaacccccaaactcatctaatttntgatgcagtcatccggcctntggtagtttcctggtccgcttctcgtcggccttccaagtcttggacctaacctcgggccctcctacgaccctatccgtcgggctcccgaggccgtggaacgggtacgacggtacttaacctttattaagttctctaacttttacaattaaccgaagaacgaacctaaacccaaactaacgttacgtgggttacggttacggggaccgggtaaacgggacccgtaaaacggttcccggtaacccgttcccggttaccgggttaaccgaaccggaccccggaaacgggtccccgtaccggtacccccccgtccggttaacccccgg

SEQ ID NO: 311909 - DNA, 790 bp, Homo sapiens
  misc_feature: GZ8MTXP02JCQQE.25.36.D03.1.454.CMB.2.raw
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggactccgcaggtccggccgggagggactggagtggattgggctatatatacgaatggacttaaccactaccaacccctcctcaagcgtcgatcaccatactcaagcggacacgtaccgagggactcgaggtcttcctgctatctcgtacttctgaccgacgtcggcccggccggaaccacccggtcccttaagtaccgttacgttggtccgacctaaggacgttacgttccgggaacttcgggacccggtaaacgttacgtttttacggaagttaaatttatttacgttacgttttgttcgtttccgttttagaaccgtaggttacggggttacggggacccggtaaaacgggggtaccggttaaacccgggtcccgttaacccggtttccgtttaccctttaccggaaccgttccccttaccccggaaccggaaaacccggggttcccccgtaaccggtttccccgggtttacccccgttccccccggttaccgggacccccttaccccccgttacccgttaacccccaaaacgggtaacccggtaaccccgtaaccccggttcgggggtacccgggggaaccccacgggtaacccggggtcccccgggg

SEQ ID NO: 311910 - DNA, 614 bp, Homo sapiens
  misc_feature: GZ8MTXP02GVX4K.25.36.D03.1.454.CMB.2.raw
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
  modified_base (469)..(469): a, c, t, g, unknown or other
  misc_feature (469)..(469): n is a, c, g, or t
  modified_base (520)..(520): a, c, t, g, unknown or other
  misc_feature (520)..(520): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtgtccgtcggggacccccggnaggagggtcctccattctcttgttcgtggggacncagctcccggacggtacggtaaaattaagtttgtctacgtggtaccagcacgcctacccaaggaaaccccgcccccaaagcctccacactctaataggaatgactcgacgccggcctgacggactaccgtgaaccgtattctcgtcggtctacgtaagtcgtcggtctcccgtccgtaccctcctcggaccacgtcgaggtcggtccgtccggtccgagtcgnggaggtctaagaattatacgtggtctagttaggttggatcgaccgtgtcgngtaggtcggtacggtcggttcgggttcgggacggacgggaaccgaacggtccgtacgacccggttacgacggtacgaccggtaccgtaaccggg

SEQ ID NO: 311911 - DNA, 724 bp, Homo sapiens
  misc_feature: GZ8MTXP02GX217.25.36.D03.1.454.CMB.2.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcgagggtcctgggcccagtctgtgctgactcagcccaccctcagtgtcgtcgggacccccggnaggacggtcctccattcttcgtttgttcgtgggtacncgacgtccgtccggacgtacggtaaaattaacggtttcgtacttacgtcgggtaaccaggccacgcctaccccgaaacggaaaccccggcccccaaagtccctacctcacttactaagtaacggaatggatccgacgtcccggacctagacgggtaactaccgtcgaaccgttctttcctacgtcgggtaccttacggacgttccgtcgggcccttcccgtacccgggtcccttacccgtcggaccctacgttcggacgggttccggggtcccttcccggggtaccggagggtaccgtagggtacggtacgttaaggtaaacttagttaccgtgggtcgtacggtttaggttcgggtactcggtaccgtgtacggtggtacggtacggggttccggacgggtttcgggacggggacggggtaacggaccgtaaaggtccgtacgtaccgtacggttacgaccgaccgaccgtaccgg

SEQ ID NO: 311912 - DNA, 707 bp, Homo sapiens
  misc_feature: GZ8MTXP02HJPRG.25.36.D03.1.454.CMB.2.raw
  modified_base (242)..(242): a, c, t, g, unknown or other
  misc_feature (242)..(242): n is a, c, g, or t
  modified_base (269)..(269): a, c, t, g, unknown or other
  misc_feature (269)..(269): n is a, c, g, or t
  modified_base (317)..(317): a, c, t, g, unknown or other
  misc_feature (317)..(317): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctccaccctcctcactcactgtgcagggtcctgggcccagtctgtgctgactcagcccaccctcagtgtccgtcgggacccccgggcaggacggtctccatcttcttgttcgtggancacgctccgaacgtcggaaattagttnctactggaccagcacgcctaccaacggaaccccgccccaagcctaccncatctaagaggaatgactcacgccgtccgtagacgggactacctacggaccttattcctcgtccgggtactacggtaacgttccgtcgtccccgtccggtcccccgtcccgttccgtcccggacctacgtccggtaacgggtcgggtacccgttcccggggacgacgggtagtcggggtaaacgtcgttaaacgaagtttaaacgttcttaggggtcctacggggttaaggttttcggggactttacgggaccttaaggttcgtaggggtaaccgggttccggggttacccgggtacgggttcggtaccgggggtacggggaccgggttaaccaaggggtcccgtaacggtcccggtaccggtaggtacccggaccggaaccggtcccgg

SEQ ID NO: 311913 - DNA, 640 bp, Homo sapiens
  misc_feature: GZ8MTXP02GYC8D.25.36.D03.1.454.CMB.2.raw
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctgggttttcctcgttgcttcttttaagaggtgtccactgtcaggtgcacctgggtggagtcgtgggggaggcgtggtccagccgtgggacgtccctgagctctccgtgtgagcctgtggtatttacgtttcagtggttcnggccatgcacgtgggtcccnccgtagcctcgacgggcgaaggggtccgagtggtggctagttangcantgactggtaaacttntagaattntagtgaccagactcggagaacgggcctatcacctagtcctacgagacgaacctaaacgttacccggaatagtttacgtacgttacgtaagggtaaatcgggtactacgggtctaggaaagtacggttcggaaacgggtaccttcccgggggaacctttcggttacgttaaacgttttacggtacgggtaacggtaccgggtaagggttacggggttacgggggtaggtttacggggtttaaacgggtttaacgg

SEQ ID NO: 311914 - DNA, 619 bp, Homo sapiens
  misc_feature: GZ8MTXP02FQMCE.25.36.D03.1.454.CMB.2.raw
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctctgtccaacacaccagcaacgccccaatcatcattatgatgtcagtcagtccggcctgtggtacgtttccgtggtcgtcttctcgtggtctccaagtctggacctaaccgtcggccctcccgtcgacctacgtccgtcggggcttccgaggtcctaggacggacgaggtcttaactttattattcgacttatttacaattaacgagtacgaacctaaccaaacgtagttacggttggttacgggttacggggacgggtaacgggtaaccgtaaacggtttccggtaacccgttcccgtcgggttaaccgaacccggacccgtaaacgggtccctacccggtcccccgttcggtttacccc

SEQ ID NO: 311915 - DNA, 665 bp, Homo sapiens
  misc_feature: GZ8MTXP02IUM28.25.36.D03.1.454.CMB.2.raw
  modified_base (212)..(212): a, c, t, g, unknown or other
  misc_feature (212)..(212): n is a, c, g, or t
tcagactgtacagtcacgaccggtgctcgatttagctgcgtcacgatctctcttgggggagcttcagctgtggtagagaagacaggattcaggacaatctccagcatggccggcctccctctcctcctcaccctcctcactcactgtgcagggtcctgggcccagtctgtgctgactcagccaccctcagtcgtcgtcggggacccccgggnaggagggtctccattctcttgttcgtgggagcagcctccgacgtacggaaattagttgtactacgtcggtacagcacgcctaccgaacgaaccggaccccaagcctcctcatctaagtaggaatgactcgacgccgcctacgacggactaccgtcgacgtattcctcgtcggtccttacgaacgttccgtcggcccttcccgtcccgggtccccttcccgtcggtccctacgtcggtacgggtccgggtcccggttacccggggtaccggaagggtacgtacgggaggtacgttacggtaaatttacgtttacgtgggtacgtggttaacggtttgggatcggtcgtacgttcggtaggtcggtacgggtccgggtacggttcggggttcgggacgggtaacggaccgtaacggcgtacggtacccgttacggtacgccgacgtaccgaacgg

SEQ ID NO: 311916 - DNA, 681 bp, Homo sapiens
  misc_feature: GZ8MTXP02HL8KX.25.36.D03.1.454.CMB.2.raw
  modified_base (541)..(541): a, c, t, g, unknown or other
  misc_feature (541)..(541): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctggcccagtctgtgctgactcacgccaccctcagtgtctcgggaccccggcaggacgggtctccatcttcgttgttcgtgggacgtcagtccgtccggaacggtacggtaaaattaaggtttcgtactacgtcggtaccagccacgacctacccgaaacgaaaccccggtcccccaaagtccctacctactaactctaagttaggaattcgataccgacggtcccggacctacgaaccggggtactaccgtacgacccgtatttccgtcgcgggtactcggaacgttctcgggtcctccgtccggcccttaccgtcgaccctagtccgtagggtccggtcgtcccgggtacggaagtgaggagtacctagaaatttctttacgggnggttagtaggttaggttcggacgtacgtccgtagttcgcgggttacggtcgggtacggtacggggtcgggtacggggacgggacggtaaccgacgtccggtaccggtaccggttacgacggaccgaccggacccgtacgg

SEQ ID NO: 311917 - DNA, 558 bp, Homo sapiens
  misc_feature: GZ8MTXP02FTOQD.25.36.D03.1.454.CMB.2.raw
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
  modified_base (351)..(351): a, c, t, g, unknown or other
  misc_feature (351)..(351): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgcccactcccaggttcaactggtgcagtctggacctggaggtgaagagccgtggggcctcagtgaaggtctcctgcaaggtcttctggttacacctttagcagctagtggcatcagcgtggtncgacncggcccctggacagggctgagtgatggcagtgatcngacctaacngtgtatcacagactgtcncgagaggtaactccgagggtacagtacgtacacttacgacacagacacactaccacgacgacacacgaccctagacgtacggacctaggaacgcgccgtagagatcgagaccgacgaccgggtacctagttaacgttcgtaggacggtacgaggtaacggtaacgtagttacgtcgttacctttaccggtaccgtacgttaaccccg

SEQ ID NO: 311918 - DNA, 687 bp, Homo sapiens
  misc_feature: GZ8MTXP02HP2YH.25.36.D03.1.454.CMB.2.raw
  modified_base (317)..(317): a, c, t, g, unknown or other
  misc_feature (317)..(317): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcgtcaccatctcctgcactggaaccagccgtgactagttggtgtacttataactatgtctccgtcgtacccaacaaccacccaggaccaaccggacccccaaatcatctatttangatgtacagtcatccggcccttgtggtcgtttccgtcgggttcctctttcctcgtcggtctcccgtaagtctggacctaccgttccggccctccctacgacctacgtccgtcggggacctccgaggcgtaggacgggacgacggtacttaacctttattattacgttacttacttttacgaacttaaccgagtaacggaaccaacctaaaacgtacgttacgttggggttacggttaccgggggacggggtaaaccgggtaaccggttaaacggttccgtaaccccgggttccgtttaccgggtaaccgtaacccgacccggtaaaccggtcccgttacccccgtaccccccggttacggtttacccccg

SEQ ID NO: 311919 - DNA, 755 bp, Homo sapiens
  misc_feature: GZ8MTXP02JG7JP.25.36.D03.1.454.CMB.2.raw
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtctcgggacccccgggnaggagggtcctccatctcttgtcgtgggancagctccgacgtacggaaattagtttgctatggtaccagcagcctacccaagaaacccggcccccaagcctccncatctataggatgaatcgagccggaccctgacgggtactaccgtcgaaccgtcttaccgtcgtcggtcctacggaacgttccgtcggtcccgttcccgtcccgggtcccccttcccgtcggtacccctagttacccggtaagggttccggggccccgttccccgggggttacccggacgggtagttcggacgggtccgttaaagaaacgttttaacgttaccgttgggttccgtacggttaagggttttcgggaacgttcggtaccccgtaagggtttcgtaaacggggttacgggttccggggttaccggggtaaccggggtttcggggttcccgggggaccgggttaaaccgggggaaacccgttaaacgggccggttaacccgggtaaccccggttccggttaagggtaccccgaaccggggtaccccgtaaacccgggg

SEQ ID NO: 311920 - DNA, 653 bp, Homo sapiens
  misc_feature: GZ8MTXP02JXHQR.25.36.D03.1.454.CMB.2.raw
  modified_base (176)..(176): a, c, t, g, unknown or other
  misc_feature (176)..(176): n is a, c, g, or t
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtcgctccgtcagtgctttatactgganctggactccgccagtccggccgggagggctgggagtggagttgggctatatatacgaatggacttaaccacctacaacccctctanagatcgancacatancagcgacacgtcaggancgagtntccngcatcgtagacttgngcgtactcggccgccggaccaccggtcccttaagtacctacgtggtcgacccaagtacgtacgttacgggactggtacccgtacgttaacgtttttacggaagttaaactttagttattcgtttgttacgttcttttagactagttgggtacggggtaccgtaaggggaccgtaccgggttaccgtaaccgttccgtaccgtttaccgaccgtcccgtacccgaaccgaaccgggtccctaacgttcccggttccctccccgtcggtaccccacccgtccctaaccgaaccgaaccgccgtacccgtcggtaccggggaccacggacggcccgg

SEQ ID NO: 311921 - DNA, 621 bp, Homo sapiens
  misc_feature: GZ8MTXP02G8SPH.25.36.D03.1.454.CMB.2.raw
tcagactgtacagtcacgaccggtgctcgatttagctgcgtcacgatctctcttggggacccaaaaaccacacccctccttgggagaatcccctagatcacagctcctcaccatggactggacctggagcattccttttcttggtggcagcagcaacaggtcgcccactcccaggttcaactggtgcagtctggacctgaggtgaagagccgtgggcctcagtgaagtctctgcaaggtcttcgtggttactacgtttagcaggctagtggcatcgagcgtggggtcgccgacgcggccccgtggacgacgggtcttggagtggatgggacagtggactcgagtaccctaacgagtcggtactcgacgaagacttagcgcaagtacggtaacgttaccggaaggggtcaaggtaccgtacctaccgttacgaccacgacaaccacgacaccgacgacgacacgtacacctacacgtcgaccgtaggaacgcgaccgtagacgtacgtacgacgttaaccgaccggttacggtaccgttaatacgttagtcggtacgacggtaagtacggttaaggtaacttacggtcgtaccggttaaccgttccggtcgttaacccccgg

SEQ ID NO: 311922 - DNA, 665 bp, Homo sapiens
  misc_feature: GZ8MTXP02ID5WV.25.36.D03.1.454.CMB.2.raw
  modified_base (189)..(189): a, c, t, g, unknown or other
  misc_feature (189)..(189): n is a, c, g, or t
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (404)..(404): a, c, t, g, unknown or other
  misc_feature (404)..(404): n is a, c, g, or t
tcagactgtacagtcacgaccggtgctcgatttagctgcgtcacgatctctcttggggagcttcagctgtggtagagaagacaggattcaggacaatctccagcatggcccggcctccctctcctcctcacccctcctcactcactgtgcagggtcctgggcccagtctgtgctgactcagccaccctnagtgtcncggtaccccggcagaggtctcatctcttgttcgtgggancagcctccgtagtacggtaaattaagtttgtctacgtcggtaaccganacgacncctacccaacggaaacccggaccccctaatcctctaccataccgtaaagttaggaaatcgatccgaaggccccgtccctacgaggggtaacctacccgtcgaaccgttctttccngtcgggtcaaccggtacgttcgtccgtccctcgtcccgtccccttccgcggactacgtcgtacgggtccggtcgttaaccgccggagtgtacggacgagttaagtaatttacgttacgtgtacgtacggtaggtttaggctccgtgtaccgtagtcgtacgggtcggggttccgggtacgttcgggggttacggacggggaacggttaccgaacggtccgtcgtaaacccgttcggacgtaccgaccggaaccgtccccgg

SEQ ID NO: 311923 - DNA, 718 bp, Homo sapiens
  misc_feature: GZ8MTXP02FXKB2.25.36.D03.1.454.CMB.2.raw
  modified_base (269)..(269): a, c, t, g, unknown or other
  misc_feature (269)..(269): n is a, c, g, or t
  modified_base (315)..(315): a, c, t, g, unknown or other
  misc_feature (315)..(315): n is a, c, g, or t
  modified_base (366)..(366): a, c, t, g, unknown or other
  misc_feature (366)..(366): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgcttcttttaagaggtgtccactgtcaggtgcacctggtggagtcgtgggggagcgtggtccagccgtgggagtccctgagactctctgtgaagcctntggtatttagttcagttggttctggcagtgccacgtcggggtcccnccgaggcctcccgagggccgaagggggccgtaggtggttggctaggtttanacgcaactagtgagttggggaatttctaggtaaatttagtttagtggacctaaacggtaccgttacccggttaggggaaaaccggggcccgttaaatttacccgaaccctagttcccctaaccgaaaggaacgtaaacccgtaaacgtttaccccgggaaactagtttacggtacgtttacgtaaggtaaagttcggtacgacgccgtaggtacggacggttacggacggtacgttcccgggtactttaccggttaggttttaaacttccggtttacggaagggtaaccggtaagggttaacggggtaccgggggttaagggtttaacgggtttaaggttttaaacccgggg

SEQ ID NO: 311924 - DNA, 579 bp, Homo sapiens
  misc_feature: GZ8MTXP02FLXCP.25.36.D03.1.454.CMB.2.raw
tcagactgtacagtcacgaccggtgctcgatttagctgcgtcacgatctctcttgggggagctctgagagcggagcccccagccccagaattcccaggtgttttcatttggtgatcagcactgaacacagaggactcaccatggagtttgggctgagctgggttttcctgtttgttatttttccaggtgtccagagtgagtgcagttggtggagtcgtgggggaggcttggtccagcctggagggtccgtgagagtctctgtgcagcctctggattcatcttcagtgaccactacatgggactggggtcccgccagggcctcccgagggggaaggggtctggggaggtggggttggccccgtattaagaaaataagctaaagagttaccaccaacagaactacgcgcgtctgtagaaacggcagtattcattatctacaagagatagattacaaagaactcactgtactctgacaaatagaacacgacccgtacgaaaaacccggaggaaccgaccggaccgtacgttacgttacctgtcgtacgtacggtacgacgtacgtaaccggtacgtaacccc

SEQ ID NO: 311925 - DNA, 692 bp, Homo sapiens
  misc_feature: GZ8MTXP02GJS5Z.25.36.D03.1.454.CMB.2.raw
  modified_base (213)..(213): a, c, t, g, unknown or other
  misc_feature (213)..(213): n is a, c, g, or t
  modified_base (247)..(247): a, c, t, g, unknown or other
  misc_feature (247)..(247): n is a, c, g, or t
  modified_base (417)..(417): a, c, t, g, unknown or other
  misc_feature (417)..(417): n is a, c, g, or t
  modified_base (576)..(576): a, c, t, g, unknown or other
  misc_feature (576)..(576): n is a, c, g, or t
  modified_base (583)..(583): a, c, t, g, unknown or other
  misc_feature (583)..(583): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgcccaccctcagtgtccgtcggggacccccgggnaggacgggtcctccattcttcttgttcgtgggancagctccgagtacgtaaattagttgctacgtggtaccagcacgcctacccgaagaaaccccggcccccaaagccctcctacatacctaagttaaggaaattcggaacttcgaacggccccggtacccctcggaaacccggggtaccttaacccgtcggaaaccccggttnttttcccgtcggtcgggggtacctacgggtaaacgttcccggtcggggttcccttaccccggtcccgggcccccttccccgtagggacccctagtcgtacgggtccgggtcccgttaccgggcccggaagtcggtgaacggtctaggtacttagttcgnggttcgngttagggtttggacttcgacctagtccgtggtacgggtcggtaccggtgggtcggttcggacggggacgacttacggctacggtcggtactaggccaacggccccgagg

SEQ ID NO: 311926 - DNA, 558 bp, Homo sapiens
  misc_feature: GZ8MTXP02G6CYI.25.36.D03.1.454.CMB.2.raw
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
  modified_base (310)..(310): a, c, t, g, unknown or other
  misc_feature (310)..(310): n is a, c, g, or t
  modified_base (372)..(372): a, c, t, g, unknown or other
  misc_feature (372)..(372): n is a, c, g, or t
  modified_base (404)..(404): a, c, t, g, unknown or other
  misc_feature (404)..(404): n is a, c, g, or t
  modified_base (471)..(471): a, c, t, g, unknown or other
  misc_feature (471)..(471): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgttatttttccaggtgtccagagtgaggtgcagttggtggagtcgtgggggagcttggtccagcctgggaggtccgtgagngtctccgtgtgcagcctcgtggattcatcttcagtnaccatacatggactgggtccncaggctaccgagggagggctggagtgggtgcccgtatagaaataagctaagacgtacaccanagaataccgcgcgtctagacgaaaggcaagtnttcattatcctaagaagagtatacgattaacaaagtaactcatagtaatctagacaaagtcaaacgngacctaaacgaaaaccggaggacgacggtaccgttataacttacgtgtcggtactagggtacctagtaccgtacgggtactaaaccc

SEQ ID NO: 311927 - DNA, 723 bp, Homo sapiens
  misc_feature: GZ8MTXP02JSE3H.25.36.D03.1.454.CMB.2.raw
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
  modified_base (427)..(427): a, c, t, g, unknown or other
  misc_feature (427)..(427): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtggtgactcagccaccctcagcgtcgtcgggacccccgggnagacggtcaccctctcttgtctggaancagctaccaatactcggaactaacnctgtagaactggtaccagcacggtcccaggaactcggaccccctaaattctactatttactagtagttactacacgccgtaccctcgacggggtcccctgaccccgtacttcctcgtcggcctaccgtaagtccgtcggacctaccctcgaccgtccccttcccgnggtaccctacgtccgtacgggttccgggggtacctacggttcgttagggaacggtaagtcggtaagggtcgttacggttacttttaacgttacgttcggtccgacgacgacgtacggtaggggtaacgtacggaaccgtacggtacccgttagtaaacggttcggggttaaggggtttcgggggttttaccgggggacgggggttaacggggaaaccgggtaacggtaccggttaaccgggtacccggttacccggtacggggtaccgtacccgggtacccggaacggttccccgg

SEQ ID NO: 311928 - DNA, 657 bp, Homo sapiens
  misc_feature: GZ8MTXP02JYH4N.25.36.D03.1.454.CMB.2.raw
  modified_base (324)..(324): a, c, t, g, unknown or other
  misc_feature (324)..(324): n is a, c, g, or t
tcagactgtacagtcacgaccggtgctcgatttagctgcgtcacgatctctcttgggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatcctcctgcacgtaggaaccagccgtagactagttggtgtacttaataactatcgtctcctcggtacccaacaaccacccgagaccaaccggccccaaatcatctactttanagtatgtacacgtctacgtccgccttcgtggtacgtttccgtggtctcgttctcgtggctccgagttcgtcggactaaccgccggtaccctccctagaccctagtccggtcgggcccttccggaggctagggacggacgtacggtaccttaacgtttattacgttacgtacttactttacgtaataccgaacgtacgaaacctaacgtacgtagtcgtagggttcggtacgggacgggaacggtaacgtacggttaccggacccgttccggttacggccgtaacccggtaccggaccggtcccgtaccccggtccccggtacggtttaccccg

SEQ ID NO: 311929 - DNA, 637 bp, Homo sapiens
  misc_feature: GZ8MTXP02FT6KN.25.36.D03.1.454.CMB.2.raw
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacagggtcctgggcccagtctgccctgactcagcctgcctccgtgtctggactcctggacagtcggtcaccatctcctgcactggaaccagccgtgacattggtgcttataactatgtctcctgtcccaacaaccacccaggcaacggacccccaaactcatcatttatgatgtcagtcagtccggccctctggtagtttcctggtcgtcttctctggctccagtctggcctaacgtcgcctccctgacccatcgtcgggcctccgaggcctggacggacggaggccttaacgtttattacgtttgtactactttactattaccgaacggaacgtaaccgaacccgaaacgtaacgtttaccggttaggggttcggttaccgggggaccggggtaacggggaaccgttaaacggttcggtaaccccggttccgttcccgggtaaccgtaacccggacccgtaaacgggcccgttaccggccccccgtcggttaccccg

SEQ ID NO: 311930 - DNA, 512 bp, Homo sapiens
  misc_feature: GZ8MTXP02G9LIS.25.36.D03.1.454.CMB.2.raw
  modified_base (246)..(246): a, c, t, g, unknown or other
  misc_feature (246)..(246): n is a, c, g, or t
  modified_base (309)..(309): a, c, t, g, unknown or other
  misc_feature (309)..(309): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacagggtcctgggcccagtctgccctgactcagcctgcctcgtgtctgggactctggacagtcggtcaccatctcctgcactggaaccaggccgtgactagttgggntcttaataactatgtctcctggtcccaacaacaccaggcaacggcccccaaatcatcatttangatgtcagctatccggccctgtggtatttcctggtctcttctctggactccagtctggcacgtcgccncgtacncnctcgcgcncgngcgngagacgagtctatatntntntatatatacagacacacactagtacgtgtcggtcggaggacggacgtacgtacgtacgtcgtcgtcgacgacgacgcgtccgtccgtcgtcg

SEQ ID NO: 311931 - DNA, 638 bp, Homo sapiens
  misc_feature: GZ8MTXP02F7CIX.25.36.D03.1.454.CMB.2.raw
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtgccccactcccaggttcaactggtgcagtctggacctgaggtgaagaagcctggggcctcagtgaaggtctctgcaaggcttctggttacacctttagcagctatggcatcagcgtgggtgacgacgacggccccgtgggaacgaaggggtcttggacggtggatggcagtggattcaagtcccttaaaccgagtacggtactaccagtaacgtactagtacgccaacgtaggtaaacttccgaaggggacaaggacttacccgtaaccgttcgaacccaacgaagacctacactaccgaacgagaccaaccgacgtaccctaagacgttacgggacccttagggaaggcccgaccgttaggagtaactcgaacgaaccggacgtaccggtaccgtattaccgttacgtggtacgaacggaaggttaccgtgttaaagttctacggtaccgtttaaccggccggttacggtacccccg

SEQ ID NO: 311932 - DNA, 744 bp, Homo sapiens
  misc_feature: GZ8MTXP02GYJDL.25.36.D03.1.454.CMB.2.raw
tcagactgtacagtcacgaccggtgctcgatttagctgcgtcacgatctctcttggggacccaaaaaccacacccctccttgggagaatcccctagatcacagctcctcaccatggactggacctggagcatccttttcttggtggcagcagcaacaggtcgcccactcccaggttcaacgtggtgcagtctggacctgaggtgaagagcgtgggcctcgagtgaaggtctctgcaaggtcttctggttactactttagcagctagtggcatcagcgtgggtcgcgtacgcggccccgtaggacgaagggtctaggacggtggatggacagtggactcgacgtaccttaaacgagttacggtataccaacgtaagtaaccgttagtacgctaaacggtaaacgggttaaaccgttacccgggagggggtaccctaaagggttaccgttacccgtaaacccgtttaccggaaaccccgtaaacgaaaccggaaccctaaaccgtaacccgttaccccgaaaccggaaccgaacccaaaccgttaacccgtaacccgttaaacgacggtaccgggtacccgtaacggggaacggacgtaccgtaggaacgtacgtcgtaacggaaccgtaacgtaccggtaccgttaaagttaccgttaggtacggttacggaccgaagggttacgtaaccgtaagtttaacggcggttaacctttaccggtaacccgggttcttaaacccccggg

SEQ ID NO: 311933 - DNA, 692 bp, Homo sapiens
  misc_feature: GZ8MTXP02GHUNE.25.36.D03.1.454.CMB.2.raw
tcagactgtacagtcacgaccggtgctcgatttagctgcgtcacgatctctcttggggacccaaaaaccacacccctccttgggagaatcccctagatcacagctcctcaccatggactggacctggagcattccttttcttggtggcagcagcaacaggtgccccactcccaggttcaactggtgcagtctggacctggaggtgaagaagccgtggggcctcgagtgaaggtctcctgcgaaggtcttcgtaggttactaccgtttagctagtctagtcggactactcgaggtcgttggggtcgaccggaccggaccgggtcccccgtagggaaccgtaaggggtctttaggaggttgggagtgggacgtagtagggacttaccgtaacggtacccttaaacgagttaccggtactacgaactacggtactacgtacgaccgtaacgaacgggtacgttaccgaggggtaccaggtacgtaccgtaccgttagaacccacgaacgaaccactaccgaccgaaacggacaccgaacgtaccgtaactaacgacggttaccgggaccgttagggaccggtaacgtcccgtaggaagtacgtacggtacgaaccgacgtaccggtaccttagtaccttggacgtacgacgtgtacgtaagtacttacgtcgtccgttacgtccggtcgtacccg

SEQ ID NO: 311934 - DNA, 560 bp, Homo sapiens
  misc_feature: GZ8MTXP02I8PVU.25.36.D03.1.454.CMB.2.raw
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
tcagactgtacagtcacgaccggtgctcgatttagctgcgtcacgatctctcttgggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcacgtggaaccagccgtgactattggtncttataactatgtctctgtccaacacaccagcaacgccccaaatcatcattangatgtcagtcagtccggcctactggtacgtttccgtggtcgtcttctcgtcggcctccaagtctggcctaacgtccggcctccctgaccagtcgtcgggcctcgaggcctggaggaccgaggcttacgttattagttacgtctatttcaaattacagtacgacaccaatagtcgtggtcggttcggcgggtaacggacctaaagttcgaaccgtccgttacggaacgcgaccgaacgggtcctcggcccccgttacggtccc

SEQ ID NO: 311935 - DNA, 624 bp, Homo sapiens
  misc_feature: GZ8MTXP02IFWYO.25.36.D03.1.454.CMB.2.raw
  modified_base (202)..(202): a, c, t, g, unknown or other
  misc_feature (202)..(202): n is a, c, g, or t
  modified_base (248)..(248): a, c, t, g, unknown or other
  misc_feature (248)..(248): n is a, c, g, or t
  modified_base (417)..(417): a, c, t, g, unknown or other
  misc_feature (417)..(417): n is a, c, g, or t
tcagactgtacagtcacgaccggtgctcgatttagctgcgtcacgatctctcttggggggggtctcaggaggcagcgctctcgggacgtctccaccatggcctgggctctgctgttccctcaccttcctcactcagggcacagggtcctgggcccagtctgccctgactcagcctgccttcgtgtctgggactccgtggacngtcgtcaccatctcctgcactaggaaccagccgtgactagttggtntcttaataactatgtctctcggtacccaacaaccacccaggccaacggaccccccaaatccatctaattatagatgtcagtcacgtcgaccctcgtggtctttccgtggttccgtcttctcgtacggccttcgaagttctcggcctaaccgtccgcctcccagtacccncgtcgcggcctcgacgtcgaggacggacgtacgtacttagtttattgttacgtacttacttacagtaacgacgtacgaactaacgtaagtacgtacggttcgggtcggttacggggacggtaacggtaacgttaacggttccgtaccggttccgtaccggtaaccgaccggacccgtacggtcccgtcccggtccccgttacgtccg

SEQ ID NO: 311936 - DNA, 623 bp, Homo sapiens
  misc_feature: GZ8MTXP02JL2VX.25.36.D03.1.454.CMB.2.raw
  modified_base (230)..(230): a, c, t, g, unknown or other
  misc_feature (230)..(230): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
  modified_base (512)..(512): a, c, t, g, unknown or other
  misc_feature (512)..(512): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcacgtggaaccncgcgtgacattggtgcttataactatgtctcctggtacccaacaaccacccaggacaacggacccccaaatcatcattangatcgtnagtcatcggcctcgtggtagtttcctggtcgtctttctctacggctaccgaaagttctacgggactaaacccgtcggaccctttccccgtacgaaccctaacgttcccgtccgggggtcccttacccgaaggggtcccagggaacgggacgacggtactttaaactttagttaaccgttgaccttatttacaaanacagaacaccaaacaacgtagtcgtggttacggtacggacggaacggaacctagtacgaccgtccgtacgaaccgacgaaccgtacggtccgtaccgtccccgtacgtacc

SEQ ID NO: 311937 - DNA, 649 bp, Homo sapiens
  misc_feature: GZ8MTXP02IQ25I.25.36.D03.1.454.CMB.2.raw
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctnagtgtctcgggacccccggnaggacgggtcctccattctcttgttctgggancagctccgacgtcggaattaagtttntctactggtaccagcagcctacccgaagaacccggccccaagtcctcctcatctagtaggaactgaactcgacgccgccctacgacgggtactaccgtacgaaccgtacttacctcgtcgggcctacggtaaacgtccgtcggcctcccgtcggccctcccgtcggacccatccgaggtcgggcccgttccgggtccgagggagtcggaggtcgtagtaattactttacgtggtcgtagtagtttgggacgttagcctaggttcgtggtaacggttcgggtccgggtacgggtttcgggttccgggaccggggtaacgggaccccgtaaggtcccgtaccggtaccggttacccggtacggtaaccgccggacccgtaaccggg

SEQ ID NO: 311938 - DNA, 651 bp, Homo sapiens
  misc_feature: GZ8MTXP02FHQOP.25.36.D03.1.454.CMB.2.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggacccccgggnaggagggtctccatctcttgttctgggancagctcgacgtacgaaataagttgtctactgtaccagcagctccaagaaccgccccaagctcctnatctanagaatgatcagcgccctgaggactaccngaccgtattcncgtggctacgaagtctcggctcccgtcggccctccgtcggccagtcaggtcgggccctccgggtaccgaggagtaggagggtctaggtaaacttagtttacgtgggtacaccgtttaggggttttaggggaacttcggacccgtaaggttccgtagggtaacggggttccggggttacccgggtaacgggggtttcgggtttaccgggggaccggggtaaacggggaccgtaaaacgggccggttacggtaaccccgggttacggtaaccgggtaccgtaaaccggcccccggtaaaacgggg

SEQ ID NO: 311939 - DNA, 633 bp, Homo sapiens
  misc_feature: GZ8MTXP02JIAHM.25.36.D03.1.454.CMB.2.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (313)..(313): a, c, t, g, unknown or other
  misc_feature (313)..(313): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctcgtgtctgggactcctggacagtcggtcaccatcctcctgcacgtggaaccngccgtgactattggtnacttagtaactntgtctctggtacccaanaaccaccagccaacggacccccaaatcatctatttacngatgtcagtcacgtccggtcctgtggtactttccgtgtcgtcttactcgtacgctcagtctgaccacgtcgaccctcgtacgaccctagtcccggtcgggtacctcgacggtctcgggaacgggttcgacggttaccttaaggttactttagttacgtattaacgttttcgaaacgttacgaagaacgttaccaaaccgtacgtaacgttcgtgggttacgttacggggacggtaaacggtacctaaaggtttccggacccttccggtacggtccgaaccgtacccggacggccctttacccggccccgtcgggttaccc

SEQ ID NO: 311940 - DNA, 599 bp, Homo sapiens
  misc_feature: GZ8MTXP02ILQ0N.25.36.D03.1.454.CMB.2.raw
tcagactgtacagtcacgaccggtgctcgatttagctgcgtcacgatctctcttggggagcttcagctgtggtagagaagacaggactcaggacaatctccagcatggccagcttccctctcctcctcaccctcctcactcactgtgcagggtcctgggcccagtctgtgctgtctcagccaccctcagtgtcgtcggggccccccgggcaggagggtcgacatctcttgttctggaagtcgctccaacgtcggcagtaataggtgtaagctggtaccagacaacctcccgaaggacccggcccccacacctcctcatgtagagggaatgatcagccgccctcgacggggtccctcgaccgtattcctctcgccctccacgtctcggcacctcacgccctcccgtcgccagtcccggtcggcctaccgaatccgtagacggtatggacggaccgttattaagttgttgtggaccgtaggtccgggtgggaattgggaaacaagggtaaggtaacgttagtcgttacggttacggaacgttacgggaaccctaaagggtccgtaccgtcgtacggtacaccggacccgaacggacccccg

SEQ ID NO: 311941 - DNA, 655 bp, Homo sapiens
  misc_feature: GZ8MTXP02GFSZK.25.36.D03.1.454.CMB.2.raw
  modified_base (269)..(269): a, c, t, g, unknown or other
  misc_feature (269)..(269): n is a, c, g, or t
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
  modified_base (477)..(477): a, c, t, g, unknown or other
  misc_feature (477)..(477): n is a, c, g, or t
  modified_base (493)..(493): a, c, t, g, unknown or other
  misc_feature (493)..(493): n is a, c, g, or t
  modified_base (505)..(505): a, c, t, g, unknown or other
  misc_feature (505)..(505): n is a, c, g, or t
  modified_base (539)..(539): a, c, t, g, unknown or other
  misc_feature (539)..(539): n is a, c, g, or t
tcagactgtacagtcacgaccggtgctcgatttagctgcgtcacgatctctcttggggagctctgagagcggagccccagccccagaattcccaggttgttttcatttggtgatcagcactgaacacagagactcaccatggagtttgggctgagtcttgggtttttccttgtttgtttatttttccgaggttgtccagagtgaggtgctaggttgggtgggagtcggtgggggaggtcgttcggtccgagtccgtgggacgggtccgngagtgtctcgtgtgcacgcctgtgtattcattctacagtcgaccactacngtcggacgtcgggtccccncgacggtccgtaccggaagggggacggggtctaggggtaggtggggttcgacccgtttaaagtaagaaaagtaaacgcgttaaaagaacttaccaaaccacgaaagaaacgtaccggcccgtgtctaggtagaaaaggnaagttatacgtattanctaagaaggtanattagaaattaacggaaaactactctaatacttntactagaacaaaattcgaaacacgaacccgtaaggaaaaccgcggaaccgacgggtacctagttaacttgtggaacgtcgttaacgggctaacgtaccggtacgttacgtaaaccc

SEQ ID NO: 311942 - DNA, 551 bp, Homo sapiens
  misc_feature: GZ8MTXP02FK7YZ.25.36.D03.1.454.CMB.2.raw
  modified_base (306)..(306): a, c, t, g, unknown or other
  misc_feature (306)..(306): n is a, c, g, or t
  modified_base (340)..(340): a, c, t, g, unknown or other
  misc_feature (340)..(340): n is a, c, g, or t
  modified_base (458)..(458): a, c, t, g, unknown or other
  misc_feature (458)..(458): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacagttggtgacttaataactatgtctcctgtcccaacaaccaccagcaacgcccccaaatcatcatttangatgtcagtcattccggccctgtggtagtttccnggtccgtcttctctaggctccaagtctggacctaaccgtcggccctcccgtgaccctactcgtcggggctccgacggtctgacggcgaagcttaacttattattgctatttcagtacngaagacaccaacagtcgtggtcgtcggcggtacgggacctaaagttcgaaccgtcgtacgcgacgacccgaaggcctaccgccccgtcgtacc

SEQ ID NO: 311943 - DNA, 862 bp, Homo sapiens
  misc_feature: GZ8MTXP02GBVBK.25.36.D03.1.454.CMB.2.raw
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (447)..(447): a, c, t, g, unknown or other
  misc_feature (447)..(447): n is a, c, g, or t
tcagactgtacagtcacgaccggtgctcgatttagctgcgtcacgatctctcttggggagcttcagctgtggtagagaagacaggattcaggacaatctccagcatggcccggcctccctctcctcctcaccctcctcactcactgtgcagggtcctgggcccagtctgtgctgactcacgcccaccctnagtgtccgtcgggacccccggnaggacgggtcctccattccttcgttgttcgtgggancagcctccgacgtacggtaaattagttcgtactacgtggtaccagcacgccctacccgaacggaaaccccggccccccaaagtccctaccctacgtaacttaccgtaagttaaacgggaaacttcggaacttacccgaccggccccggtacccccgttaggaccggggtaaacctttaccccgacggtaaaccccgttnttttcccgtaacggttcggggtcccttaaacggtaaaccggtttcccgtaccgggtccccctttcccccgggcccccgggtaaccccctttccccggtaccggccctaaacgttcccgggtggggttccccggggacccccgttccgggggttaccccgggaaggtacgttcggggaaccggttaccgtaaagtttaaatttaacgtttaccgttagggtcgtaaccgtttagggggttttcggatttccggaacgtccgggttaagtacggggtcggtttaaccggggttccgggtaacggggttttacggggccggggtacggggtaaaaccggggaccctaaacgggtccggttacccggtaaaccccggttggttaccggaacccgtaaacccggtccccggttaaaccgg

SEQ ID NO: 311944 - DNA, 634 bp, Homo sapiens
  misc_feature: GZ8MTXP02FXUQI.25.36.D03.1.454.CMB.2.raw
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactctggacagtcggtcaccatctcctagcactcggaaccncgccgtanactgttggtctacttaatactntcgtcctctcgacccaacaaccaccgagaccaaccgaccccaatcatactattatgtatcgtacacgtctacgttccgtcctgtggttcgttccgtcgtctacttctcgtacgtctcgtacgtcgtacggacctaccgtccgtccctctaccgtacctcgtccggtaccggctccgcggtcgtacggacggacgtacgtacttactttagttagttcgtacttattacagtaactaacgacgaaaccgaactaacggttacgtggttacgggtacggtacggggacggaacggttaacgtacggttaccgaccgttccgtaccggtaaccgaccggacccgtacggtaccccgtccggtaccccgtacgttccc

SEQ ID NO: 311945 - DNA, 649 bp, Homo sapiens
  misc_feature: GZ8MTXP02IUAME.25.36.D03.1.454.CMB.2.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (267)..(267): a, c, t, g, unknown or other
  misc_feature (267)..(267): n is a, c, g, or t
  modified_base (301)..(301): a, c, t, g, unknown or other
  misc_feature (301)..(301): n is a, c, g, or t
  modified_base (441)..(441): a, c, t, g, unknown or other
  misc_feature (441)..(441): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagccaccctcagtgtcgtcgggaccccggnaggaggtctcatctnttgttctggncagcnccgagtcggaaattagttgctactgtaccngcagcctaccaacgaaccgccccaagtcctcctnactactaagtagaaattgatcagccgcccgtagaacggactaccgtgacccgtatttctcgtggtctacgaacgtccgtggccctccgtcccgccctacctcggccacgtcgaggttcggccggtcccggtcgagggtancggagtctagtaatttagttcgtggtagacgttagggtttggggactcggccgtaggttacgttacgggtacggttccgggggtttaacccgggtagggttccgggggtttacggggaccgggggtaacggggaacccgtaaacggtccgtaccgggttaacccggtttacccggaaagggttcccgaaccggttaccccggaaccgg

SEQ ID NO: 311946 - DNA, 775 bp, Homo sapiens
  misc_feature: GZ8MTXP02FWEB1.25.36.D03.1.454.CMB.2.raw
  modified_base (193)..(193): a, c, t, g, unknown or other
  misc_feature (193)..(193): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (278)..(278): a, c, t, g, unknown or other
  misc_feature (278)..(278): n is a, c, g, or t
tcagactgtacagtcacgaccggtgctcgatttagctgcgtcacgatctctcttggggagcttcagctgtggtagagaagacgaggattcaggacaatctccagcatggcccggcctccctctcctcctcacccctcctcactcactgtgcacgggtcctcgggcccagtctgtgctgactcacgccaccctnagtgcgtcgggaccccggnaggnggtctcatctcttgtgnggancagcctcggacgtacggtaattagttgtctagtcggtaccngacgtacgcctaacccgaacgaaccccggtaccccaagtccctacctacgtaactaccgtaagtaaggaacttagaccgttaccgaaccgtccggtaaccccttaggaaccgggtaccttaaccggacgtaacccggttacttccgtcggttcggggaccttacgggtaaaccgttccggtaccgggtcccttccggtcccggtaaccctccgtcggaacctacgtcgtaacgggtcgggtcccgttaacggggcgagggaacgtcggtacgtccgttaaaggtaactttacgttaccggtaggtcggttaaacccgttgggtttaacggggcttaacggcccggttaaggtccgtcgggtaacggttccggggttaaaccgggtccggggttggttaccccgggaaagggggaaaccggtacccgttaaacggcccgtttacgggaaacccgttaaaccgggtacggtcccaaaacccggcccgtttaacccgggg

SEQ ID NO: 311947 - DNA, 757 bp, Homo sapiens
  misc_feature: GZ8MTXP02FJ0P7.25.36.D03.1.454.CMB.2.raw
tcagactgtacagtcacgaccggtgctcgatttagctgcgtcacgatctctcgttggggggggtctcaggaggcagcgctctcgggacgtctccaccatggcctgggctctgctgttcctcaccctcctcactcagggcacagggtcctgggcccagtctgccctgactcagcctgcctcgtgtcgtgggactcctggacagtcggtcaccatctcctgcacgtggaaccagccgtgactagttgggtgtacttaataactatgtcctccgtcgtacccaaacaaaccacccgaggaccaaccgacccccaaatccaatctaatttatcgtaatgtactagtctacgtccgtcctgtcggtacgtttccgtcgtcgtcttcgtctcggtctccgtaagtccgtacggactaacccgtccggtcccctcccgtacgtaccctcgttcccggtaccgggggtcctacccggtaggtccgtacgggaaacgggtaccgggtaacgtactttaaaccgtttaattacgttacgtaccttacttttaccgaaattaaccgaacggaaacgtaaaccctaaaccgtaaaacgtccggtttacggttacggggttccgggtttacgggggaaccggggtaaaccggggttaaaccgtaaaccgggtttaccggtaccccggttccggttaccgggtaacccgtaaacccggacccggtaaacggttccccgtaaccccggtcccccggttcggtttaacccccg

SEQ ID NO: 311948 - DNA, 685 bp, Homo sapiens
  misc_feature: GZ8MTXP02JAY8V.25.36.D03.1.454.CMB.2.raw
  modified_base (217)..(217): a, c, t, g, unknown or other
  misc_feature (217)..(217): n is a, c, g, or t
tcagactgtacagtcacgaccggtgctcgatttagctgcgtcacgatctctcttggggggggtctcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctccngcactggaacccagccgtgacagttggtgtcttaataactatgtctctgtcccaacaacacccaggcaacggccccaaatcatcattatgatgtacagtctactccggcccttcgtggtacgtttccgtcggtccgtctttctcgtcggtcctccgtaacgttcgtcgggtacctaaccgttccgggtaccccttcccgtcgaaccctacgttcccggtcgggggtcccttcccgaacgggtccgtacgggacgggtaaccgacggtcttaaacctttagtttaacgttcgtacttactttacaagttaaccacggaacgtaccaaacctaactacgtcgttacgggtcggttaccgggacgggaacgggtaaccgtaaacgggttccgtaaccccgtccgttaacggtcccgaaccggtacccgtaaaccggcccgttccccggtacccccgtttacgggtaccccc

SEQ ID NO: 311949 - DNA, 680 bp, Homo sapiens
  misc_feature: GZ8MTXP02HKAG7.25.36.D03.1.454.CMB.2.raw
  modified_base (293)..(293): a, c, t, g, unknown or other
  misc_feature (293)..(293): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagtcttgggttttccttgtttgttatttttccaggtgtccagagtgaggtgcgagttgggtggagtcggtgggggaggcttggtccagccgtgggagggtccgtgagagtcctccgtgtgcagcctgtggtattcatctnagtcaaccatactagtcggacgtcgggtcccgccgaggcctcggaggggaaggggcgtaggggaggttggggttcgtaccccggttaagtaaaggtaaaactaaaaggtacctaaaaggtaagttaccaaacctaacaaagaaacgttaccggaccgtcgttacgtagtagaaagtcgagtattacgtattatctactaagagtatagaacttaaacgaaagtactacctagttagtactacgtagtaaaacaaagtacgaaacgtacgtaaccgtaaaacggaaaaccgggtacggaaaccggtacggttaccgttacggtttaacttacggtagtaacggtacgttaacggtacgtaacggtaccggttaccgttacgtaacccc

SEQ ID NO: 311950 - DNA, 712 bp, Homo sapiens
  misc_feature: GZ8MTXP02H9RQK.25.36.D03.1.454.CMB.2.raw
  modified_base (215)..(215): a, c, t, g, unknown or other
  misc_feature (215)..(215): n is a, c, g, or t
  modified_base (599)..(599): a, c, t, g, unknown or other
  misc_feature (599)..(599): n is a, c, g, or t
  modified_base (613)..(613): a, c, t, g, unknown or other
  misc_feature (613)..(613): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtcgctgactcacgcccaccctcaggtcgtccgtcggggacccccggnaggacggtctccattcttcgttgttcgtgggagcagccgtaccggacgtacggaaattagttcgactacgtggtaccagcacgcctacccgaacggaaaccccggccccccaaaggtccctacctacctaacgttaccttaaagtaacgggtaatacgtaacgtcccgaacggtccccggtaccccttacggaacggggtaaccttaaccccggtacgtaacccggttacgttcccttacgtccgggtaccgtttacggtaaccgttcgtcgggtccctaccggtttcccgccccgttcccgacggtaccacgtcgtccgggttcgggtcccgtacccggggtaccggaaggtcgtaggacggtattagaagtttagtcgtggntacgttagtttggngtcgcgtgttcgtgggtgtcgggtacgggtcgttcggggtacggacggtaccgggacacggtccgtacgaccgttcggtacgacgccggaaccgtccgg

SEQ ID NO: 311951 - DNA, 626 bp, Homo sapiens
  misc_feature: GZ8MTXP02FQ1PF.25.36.D03.1.454.CMB.2.raw
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
  modified_base (470)..(470): a, c, t, g, unknown or other
  misc_feature (470)..(470): n is a, c, g, or t
  modified_base (489)..(489): a, c, t, g, unknown or other
  misc_feature (489)..(489): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcaggtcctgggcccagtctgtgctgactcacgccaccctcagtgtcgtcggggacccccgggnaggacgggtctccattcttcttgttcgtgggancagcctccggacgtacggtaaattagttgtctacgtggtaccagcacgcctaccgaacgaaacccggcccccaagccctcctacatactagtaaggaatgaactcgacgccggcccctagaccgggtactaccgtagaccgttattcctcgtggacctacgagtccgtcgctcccgtccggtccctaccgcggctacgtcgtggtcggacctccgggtacgagacgngagtctagaattcttacgngtagccgttagggttggacttcgccgtagttgtagggtacggttcggtacccggtgggttcgggtacggggaccgggaacgggaccctaagccgtacggtacccgtacggtacggtaccaacggaccccgtaacggg

SEQ ID NO: 311952 - DNA, 581 bp, Homo sapiens
  misc_feature: GZ8MTXP02FPEFB.25.36.D03.1.454.CMB.2.raw
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (434)..(434): a, c, t, g, unknown or other
  misc_feature (434)..(434): n is a, c, g, or t
  modified_base (460)..(460): a, c, t, g, unknown or other
  misc_feature (460)..(460): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgttattttccaggtgtccagagtgaggtgcaggttggtggagtcgtgggggagcttggtccagccgtgggagggtccgtgagagtctctgtgcagcctngtatcatctnagtcaccatacagtggactcgggtccgcgaggcctaccggaggggaggggctgggagtggggtgcccgttaataagaaataagctaagataccaccaanagaactaccgccgngtctagagaaacggtntaatnttanatacacaagaagatntacgtaataacgaaactactctagtntactacgaagaaactaaagaacgaacgaacgtaacgtaaacggaaaacggaaacgaacgtacggtacgtacgttacgtacgtagtaagtacgtacgtacgtacgtacgtacgtacgtaccg

SEQ ID NO: 311953 - DNA, 667 bp, Homo sapiens
  misc_feature: GZ8MTXP02G37JW.25.36.D03.1.454.CMB.2.raw
  modified_base (315)..(315): a, c, t, g, unknown or other
  misc_feature (315)..(315): n is a, c, g, or t
  modified_base (408)..(408): a, c, t, g, unknown or other
  misc_feature (408)..(408): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagctggggttttcctcgttgcttcttttaagaggtgtccactgtcaggtgcacctggtggagtcgtgggggaggcgtggtccagccgtgggacggtccctgagactctctgtcgagcctgtgtattagttcagttggttctggcatcgctacgtcggggtccnccgaggtcctaccgaggaaccgaagggggccgaggttcggtggctaaggttatagctacatggtaatggggtaaagttctaagaaattattangacagtactccggtagaacggggtcctaattccaccctatacccgtaccgaaaggtaaacgtaaaccgtaaacgttttaccccgggaaaattagtttacggggtaacgtttaaccgttaagggaaaaggtttcgggactaacggtaccttagggaaacgtacggttacggacggaacgttccgggtattaccgttagttacgttaactggtaacgcggtaacgtaggtaccggggtaggttacggtaaggtttaacggg

SEQ ID NO: 311954 - DNA, 604 bp, Homo sapiens
  misc_feature: GZ8MTXP02G321G.25.36.D03.1.454.CMB.2.raw
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctcagtgtcgtcgggacccccgggnaggaggtcctccatctcttgtctgggancagctccgagtcgaaatagttnctactggaccagcagcnccagaacccgccccagcctctcatctataggaatgatcgacgccggcctgacggtactacctacgaccgtacttcgtacgtcggccgtacgaaacgttccgcggtcctcccgtccggtccctacccgtccggccagtcgaggtccgggccttccgggacgtagacgtgaggtctagtaaacttagttacctgggtacacggttagggtttcggactcggaccttaggtcgtaggtcggttacggtccggtaacgggttcggttaccgggggacggacggaccgtaacgggcttacggacccgttcgacgtccggacgaccccgacgg

SEQ ID NO: 311955 - DNA, 704 bp, Homo sapiens
  misc_feature: GZ8MTXP02FW4TW.25.36.D03.1.454.CMB.2.raw
  modified_base (187)..(187): a, c, t, g, unknown or other
  misc_feature (187)..(187): n is a, c, g, or t
  modified_base (210)..(210): a, c, t, g, unknown or other
  misc_feature (210)..(210): n is a, c, g, or t
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (262)..(262): a, c, t, g, unknown or other
  misc_feature (262)..(262): n is a, c, g, or t
tcagactgtacagtcacgaccggtgctcgatttagctgcgtcacgatctctcttggggagcttcagctgtggtagagaagacaggattcaggacaatctccagcatggccgcctccctctcctcctcaccctcctcactcactgtgcagggtcctgggcccagtctgtgctgactcacgccaccctnagtcgtcgtcgggaccccccggnaggcggtcctcattcttcttgtcgnggncagctacgacgtagtaattagttntctacgtcgacagcacgccaccgaacgaacccgccccatcctcactatactaagtagtatcgactccgacggccgtaccgtacgaccggtactaccgtagtaccctcttccgtcgtcgtacgtacggtacgtcgtccgtccgtccgtcccgtccctcccgtacggcctacgtcggtacgggtcggcccgttaccgggacggtaggtacgtaggtacggtacgtaaggttaactttacgtttacggtacgtggttagttagggtttagggacgttccgacggttacggttcggtacggggttaccggggttcgggttcccgggggttacggggttccgggttaccgggggaaccggggtaaaccgggtaccgtaacgggtcccggttaccgggtaacccggttacggttaccggacccggaaccggtaccccggtaacccggg

SEQ ID NO: 311956 - DNA, 746 bp, Homo sapiens
  misc_feature: GZ8MTXP02JMTS7.25.36.D03.1.454.CMB.2.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcaggtcctgggcccagtctgtgctgactcacgccaccctnagtcgtcgtcgggacccccggnaggacggtcctccattctcttgtcgtgggncagcctccgacgtacgtaattagttnactacgtcggtaccagcacgcctaccgaaacgaaccccggccccaagtccctcctacgtacttacgtaagtacggaatgtactacgaccggtccgcccgttagaacccgggtactaccgtacgtaccgttacttcgtacgtcgtacgttacggtacgttccgcgtcctccgtaccggtccctcgtcgacctagtcgtacgggtcgtcccggtacggtcggaagtgtacgggtacgtacgtaagttaagtttaccttcggtaacgggttcgtaaaggttcgggtttaacggccgtttaacggaccggtttgggtaacggtacccgggggtttagggtccccgggtttaacggggtccgggggttacgggttaaccgggggtaccggaaaccgggtacccgtaaacgggttcccgtaaaaccgggggttccccgtttaaaccgggtcggaccccgaaacccggggtttacccggtaccccggg

SEQ ID NO: 311957 - DNA, 643 bp, Homo sapiens
  misc_feature: GZ8MTXP02JSWHE.25.36.D03.1.454.CMB.2.raw
  modified_base (213)..(213): a, c, t, g, unknown or other
  misc_feature (213)..(213): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
tcagactgtacagtcacgaccggtgctcgatttagctgcgtcacgatctctcttggggagcttcagctgtggtagagaagacaggattcaggacaatctccagcatggccggcctccctctccctcctcaccctcctcactcactgtgcagggtcctgggcccagtctgtgctgactcacgccaccctcagtcgtcgtcggggacccccgggnaggacggtcctccattctcgttgttcgngggancagctaccggacgtacggaaattagttcgctagtcggtaccagccacgcctaccgaaacggaaccccggcccccaagtccctcctactatactaagtaacggaatgactcgacgccggccctagaccggtactaccgtgtacctactttcncgtggcctacgaacgttccgngtaccctccgtcccggtccctcctggcccagtcgacgggtccggccgttccgggaccggaagagtcgaacgggtcttaagaacgtttaagtcgttggtacgtcgtttagggttcgggactacggccgtaggtcgtaggtacggttccggggtccggtacggttcgggtaccgggacgggacggtaacccaggtcgtacgtacggtccgaggtaccgcgacgtccg

SEQ ID NO: 311958 - DNA, 635 bp, Homo sapiens
  misc_feature: GZ8MTXP02JZD95.25.36.D03.1.454.CMB.2.raw
  modified_base (187)..(187): a, c, t, g, unknown or other
  misc_feature (187)..(187): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagttgggctgagcttgggttttccttgttgtttattttccaggtntccagagtgaggtgcagttggtggagtcgtggggggagtcgttggtccaggtcccgtgggacgggtccgtagagtacgtctccgtggtcgcaggccctcgtggacttcattcttcaggtcgaaccctacgtacgtcggtacgtacggggtccgaccgacggcgtaccgaggggaaggggcgtggaggtggggtgtacgagttagaaataagactagaagttacaccacagactacgccgcgtactgacgtaaaggcagtactactagttaatcttacgaaagagtatagtaaattacaaaacgacttaccacgttagtattaccgtagtaaccaaagtaggaaacaacgtaccgtaaacgaaaacccggaaggacgaaccgggtacgtacgttataacgtcggtagtaacgtacggtacgtaacacggtacggtactacctaaacccc

SEQ ID NO: 311959 - DNA, 618 bp, Homo sapiens
  misc_feature: GZ8MTXP02GGP1V.25.36.D03.1.454.CMB.2.raw
  modified_base (200)..(200): a, c, t, g, unknown or other
  misc_feature (200)..(200): n is a, c, g, or t
  modified_base (234)..(234): a, c, t, g, unknown or other
  misc_feature (234)..(234): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (457)..(457): a, c, t, g, unknown or other
  misc_feature (457)..(457): n is a, c, g, or t
  modified_base (563)..(563): a, c, t, g, unknown or other
  misc_feature (563)..(563): n is a, c, g, or t
tcagactgtacagtcacgaccggtgctcgatttagctgcgtcacgatctctcttggggagcttcagctgtggtagagaagacaggattcaggacaatctccagcatggcccggcctccctctcctcctcaccctcctcactcactgtgcagggtcctgggcccagtctgtgctgactcagtgtccgtcgggacccccggnaggacgggtctcctattctcttgttcgtgggacncagcctaccggacgtacggtaaattagtttcgtactacgtcgtaccagcacgcctacccaacgaaaccccgcccccaagcctacctacatacctaagtaggaatcgactcgacgccggaccctagacggtactaccgtgaaccccgtattcgcgtcgactacgacgtcgtcgctaccgtccgtccctaccgngccctancgaggtcggccgtaccggcggagngtcggaagtctagtaattacttagtcgtagtcgtagggtttcggcgtacgccgtagtcgtgggtacgtcgggtcgtacgggtcggtacgggacggacgggaaaccncggtcgtaccgtaccgtagaacggtcgaccgaccgtacgcccgtccgtcccgtcg

SEQ ID NO: 311960 - DNA, 559 bp, Homo sapiens
  misc_feature: GZ8MTXP02IREPP.25.36.D03.1.454.CMB.2.raw
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (475)..(475): a, c, t, g, unknown or other
  misc_feature (475)..(475): n is a, c, g, or t
  modified_base (522)..(522): a, c, t, g, unknown or other
  misc_feature (522)..(522): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgcttcttttaagaggttgtccacttgtcaggtgcaccgtggtggagtcgtgggggaggcgtggtcagcgtgggagtcccngagctctctgnacgctctgtntttagttcngttgtcngcntgcngtggccncngcncgnggcgagggcgngtgtgctagtangcanatgagtggtaattctagtaaattattatgcaagtcgtccggtaggaacgggctagttcaccagtcccacagaacgaactaaccttaccggaattagtttcggtagttacgtaagtaaacgtcggttcacgttcgaagngaacgtcggagtccgtccgtcttactagtttacgtcgtaggtaacgngaaggttggacggggttaggttgggttaaacgttcgg

SEQ ID NO: 311961 - DNA, 604 bp, Homo sapiens
  misc_feature: GZ8MTXP02H9YZI.25.36.D03.1.454.CMB.2.raw
  modified_base (184)..(184): a, c, t, g, unknown or other
  misc_feature (184)..(184): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (385)..(385): a, c, t, g, unknown or other
  misc_feature (385)..(385): n is a, c, g, or t
  modified_base (427)..(427): a, c, t, g, unknown or other
  misc_feature (427)..(427): n is a, c, g, or t
tcagactgtacagtcacgaccggtgctcgatttagctgcgtcacgatctctcttggggagctctgggagaggagcccagcactagaagtcggcggtgtttccattcggtgatcagcactgaacacagaggactcaccatggagtttgggctgagcttgggttttcctcgttgcttcttttaagnggtgtccactgtcaggtgcacctggtggagtcgtgggggagcgtggtcagccgtgggngtcccngagctctctgtgagcctntggtattgttcagtgttctggcatgcacgtgggtacccnccgaggcctccgagggcgaagggggccgaagtgggtggctagttanagcangtagagtgggtaattcagtaattagttancgactagtacgtccggtagaacggggcctacttccgaacctntaccgtacccgaagacggtaacctaaaccgtttaccccggaaagttcgtttaggtacggttaaccgttagggtaaagttcgggtacagtccgtagacgtaggtcgaggtacctcgggtctacgtcgttaacttcgtagtgacggaagtcggtagggtacggtttaggtagtttacgg

SEQ ID NO: 311962 - DNA, 680 bp, Homo sapiens
  misc_feature: GZ8MTXP02FIAG0.25.36.D03.1.454.CMB.2.raw
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
  modified_base (449)..(449): a, c, t, g, unknown or other
  misc_feature (449)..(449): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcacccctcctcactcactgtgcagggtcctgggcccagtctgtgctgactcagcccaccctcagtgtcgtcggggaccccccgggnaggagggtctccatctcttgttctgggancagctccgacgtacggaataagttgtctactggtaccagcagcctcccaagaaccggccccaagcctcctcatctaataggaatgatcacgccggtccctacgacgggtactaccgtgaaccgtattccgtcgtcgggcctacggtaaagtcgtcggcctcccgtccgccctcccgtcggcccatcgagttcggcctccgggtacgnggatggagctagtaatagttactggtagtacgtaggtttagggacttccggaccgtaggtttcgtagggtaacgggttccgggggttacccgggttaacgggggtttcggggtttaccgggggtaccgggggaaaacgggggtaacccgtaaacgggtccgttaaccgggtaacccccggtttacccggtaacgggttacccgacccgggttaaccccggtaaacccgggg

SEQ ID NO: 311963 - DNA, 770 bp, Homo sapiens
  misc_feature: GZ8MTXP02FRUNC.25.36.D03.1.454.CMB.2.raw
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
tcagactgtacagtcacgaccggtgctcgatttagctgcgtcacgatctctcttggggagcttcagctgtggtagagaagacaggattcaggacaatctccagcatggcccggcctccctctcctcctcaccctcctcactcactgtgcagggtcctcgggcccagtctgtcgctgactcacgcccaccctcagtcgtccgtcggggacccccggnaggtacgggtcctccattccttcgttgttcgtggggacncgacgtccgtacggaacggttaacgtaaattagttcgtactacgtacgacagaccacgacctaaccgaaccgaaccccggacccacgtcctacctactacttacgtaagtaacggtactacggtactacgaccggtcccgtacccgtaggaacccggtaccttaccgtacgtacgttacttccgtacggtcggtccgtacggtacgttccgtccgtcccgttcccggtcccggtcccgttccggtaccgtaccgtacggtcgggtacggggtcccggtcccggtacggtacggagtacggtacggtacggttaacttaagtaactttcggttagtcggttacgtacggtttgggttacggtctacggtaccggttaggttcgggtacggtttacggggtaccggggttaccgggttacggggttacggggtaccggggaacggggtaacgtaccggtaacggtccgttaccggggtacccgttacggtacggtaccgaaccgggaccgtacccgg

SEQ ID NO: 311964 - DNA, 688 bp, Homo sapiens
  misc_feature: GZ8MTXP02GJ44C.25.36.D03.1.454.CMB.2.raw
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (322)..(322): a, c, t, g, unknown or other
  misc_feature (322)..(322): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgttattttccaggtgtccagagtgaggtgcaggttggtggagtcgtgggggagtcttggccagccgtgggagggtccgngagngtctctgtgcagcctcgtggacttcgattcttcagtcgacccactacagtcggacgtcggggtcccnccgaggcctacccgggaaggggaaggggtcgtaggggtaggtggggttcggaccccgttaagtaagaaaagtaagtactaaaggacttaccgacccaaagaacgtaaacgtcccggcgtacgttccgtagggtaagaaaacggtccgaaaggtatttacctaatttacgtcgttaacgaaaggtatagttagtaacttaacgaaaacgttacactaacgttagtaactcgtaacgaactaaagtacaaacgtacgtaaccgtaaacggaaaacccgtaggaaacccgtaacggggtaccgttagtaaaacttcgtggtaacgtaccgtaaggtactaacggtacggttaccggtacgttaaacccc

SEQ ID NO: 311965 - DNA, 637 bp, Homo sapiens
  misc_feature: GZ8MTXP02FK9N1.25.36.D03.1.454.CMB.2.raw
  modified_base (270)..(270): a, c, t, g, unknown or other
  misc_feature (270)..(270): n is a, c, g, or t
  modified_base (311)..(311): a, c, t, g, unknown or other
  misc_feature (311)..(311): n is a, c, g, or t
tcagactgtacagtcacgaccggtgctcgatttagctgcgtcacgatctctcttggggagctctgagagcggagccccagccccagaattcccaggtgttttcatttggtgatcagcactgaacacagaggactcaccatggagtttgggctgagcttgggttttccttgttgttatttttccaggtgtctagagtgaggtgcagttggtggagtcgtgggggagcttggtccagccgtggagggtccgtgagagtctctgtgcagcctntggattcatcttcagtcgaccactacatggactgggtcccncgacggcctcccgaggggaggggctggggagtggggttcgcccgtattaagaaataagctaagagttaccaccaacaagaactaccgccgacgttcgtagtcgaaaaggcaagtattcctaattatacctacgtaaagagtattaggtaattaacgaaaacgtaacctacgtaaccgttataactacttacgaataaaacgtacgaaacgacgtacctaaacggaaaaacccgacgggtaaaccgaccgggtaccgttaagttaaacgttccgtagtcggtacgtaacgggttacaggtaacccgttaacggtacgtttaaacccc

SEQ ID NO: 311966 - DNA, 649 bp, Homo sapiens
  misc_feature: GZ8MTXP02GBE4X.25.36.D03.1.454.CMB.2.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcagcccaccctcagtgtctcgggacccccgggnaggagggtctccatctcttgttctgggancagctccgacgtacggaaataagtttgtactacgtggtaccagcagcctcccgagaaaccgccccaagctcctcatctatagatgatcagccgcctagacgggactaccgtgaccgtacttcgttactgggctcggtaaagtccgtcggtcctccgtcccggccttcccgtcggaccacgtcgacggtcggggcccttaccggggtccgaggtaacgtggtaaacgggtaccttaggggtaaaactttacgtttacgttacgggttacgaccggttaaggttttcgggacgttcgtaaccgtagtacgtgggtaacgttgggtacccgtagggttacggttcggggacgggacgggtaccaaggaacgttaccggaaccggttacgtacggtacgacgtcccgtaaacggg

SEQ ID NO: 311967 - DNA, 806 bp, Homo sapiens
  misc_feature: GZ8MTXP02JG41S.25.36.D03.1.454.CMB.2.raw
  modified_base (188)..(188): a, c, t, g, unknown or other
  misc_feature (188)..(188): n is a, c, g, or t
  modified_base (253)..(253): a, c, t, g, unknown or other
  misc_feature (253)..(253): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgcagggtcctgggcccagtctgtgctgactcacgccaccctnagtcgtccgtcggggacccccggacggacggtcctaccattccttcgtttacgttcgtagggacncacggtcctacccggacggtaaccggtaaaattaagtttcgtactacgtcggtaaccagcacgacctaccgaacgaaacccggccccaagtcctcctacactactaagtaacggtaatcgaactcgaacgtccgacccgtagaaccgggtactaccgtacgtaaccgtattccgtccgtggcctaacggtaacgtccgtacgtccctccggtcccgtacccgtccgtacgtacctaagttccgcggggttaccggcccggttaccgggttaccggagtacggtcggtaaacggtcgtaaacggttaacgtttaagtttaccgtgggttaaccgtacgggtttaaacggggtttggtacgttaccggtacccggttaaagtccggggttaaacggttaccggggttacggggtttccggggtttaaacccggggttggggttaacccgggggaccggggttaaaacccggaaccggttaaacggtccggtacccggtttaacccgggttaacccggtcgggtaacccgacccgggtaacccggttaaccccggg

SEQ ID NO: 311968 - DNA, 682 bp, Homo sapiens
  misc_feature: GZ8MTXP02FH6MT.25.36.D03.1.454.CMB.2.raw
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
tcagactgtacagtcacgaccggtgctcgatttagctgcgtcacgatctctcttgggagatgggtcctgtcccagatgcacctgcaggagtcgggcccaggactggtgaagccttcggagaccctgtccctcacctgcagtgtctctggtggctccgtcagtgcttattactggagctggatccgccaggtccggccggggaggggactgggagtggattgggctatatatacgaatgattaaccacctacacccctctacaagntcgagtcacatancagcgacacgtccagggatcgaggtgttcngctatcncgtacttcgngccgatcggccgccgacnccgacctatacctacgtgtcgaccaggtagtacttccggactcggacgtacgttagtttttacggaaagttaaatttagtttactttacgtttgttacgtttactttttgaacgttcgttagggttcgggggtaaccgtaaacgggggaccggtaccgggttacccgtaaccggttccgttaccgttacgaccgtccccgtacccgtaacccggaaccgggcccctaacggttcccggttacccgtttcccccgtacggtcccctacccccgttcccgacccgtaaacgaaccgtacccgtaccgtcggggtacgggacctaaccggacggtccccggg

SEQ ID NO: 311969 - DNA, 707 bp, Homo sapiens
  misc_feature: GZ8MTXP02FJRVF.25.36.D03.1.454.CMB.2.raw
  modified_base (189)..(189): a, c, t, g, unknown or other
  misc_feature (189)..(189): n is a, c, g, or t
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
  modified_base (384)..(384): a, c, t, g, unknown or other
  misc_feature (384)..(384): n is a, c, g, or t
tcagactgtacagtcacgaccggtgctcgatttagctgcgtcacgatctctcttggggagcttcagctgtggtagagaagacaggattcaggacaatctccagcatggcccggcctccctctcctcctcaccctcctcactcactgtgcagggtcctgggcccagtctgtgctgactcacgccaccctnagtcgtcgtcggggaccccccgggnaggacgggtcctcctatcttntttgttcgtgggancagctacgacgtagtaatagttntctacgtggtaccagcagcctaccaaggaacccggtccccaagccttccgtanactacgtaagtaggaactggaactacgacgtccgtcccctaggaacgggtacctaccgngtaaccgtcttaccgtcgtcggtactacggtaaagttccgcgggtccctccggtcccgaccccgttccgtccggacctacgtccgtaaggtcccgggtcccgttacccgggacggaaggtacgtcgggaaacggtccgtaaggtaacttacgttacggtaggtcgttacggttagggtttaggtacgtacgtaccgtaacgttcgtacgggtacggttacgggtttacccgggagggtttccggggttcggggaacggggtacggaacccgtacggtaaccgtacggtacccgtacgttacggaccgaccggtaacgacccgg

SEQ ID NO: 311970 - DNA, 612 bp, Homo sapiens
  misc_feature: GZ8MTXP02FM285.25.36.D03.1.454.CMB.2.raw
  modified_base (230)..(230): a, c, t, g, unknown or other
  misc_feature (230)..(230): n is a, c, g, or t
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (457)..(457): a, c, t, g, unknown or other
  misc_feature (457)..(457): n is a, c, g, or t
  modified_base (559)..(559): a, c, t, g, unknown or other
  misc_feature (559)..(559): n is a, c, g, or t
tcagactgtacagtcacgaccggtgctcgatttagctgcgtcacgatctctcttggggacccaaaaaccacacccctccttgggagaatcccctagatcacagctcctcaccatggactggacctggagcattccttttcttggtggcagcagcaacaggtcgcccactcccaggttcaactggtgcagtctggacctggaggtgaagagcgtgggcctcagtgaggtcnctgcaagtcttctggttacacttgcagtctagtgcatcagcgtggcncgacgacggcccctaggacgaacgggtntaggaggtgaggtgacgtagnggactacgaacgtaccttaaccgtagttacggtaactacaagacgtaccttagacgacgaacgtaggtaaacgtaccgagggactacgtacgtaccgaccgttacacaacgacaacacaacgacaaccganacttaacgacctacctaaactcgtacggtaccagggaacgacccgtgtaaggacttacacgttacgaacgacgtacgtaccgttaattacaggttcgaccgnggaacctaggtaacgtacttagtacgttacgttacggccggtttaaccgtccg

SEQ ID NO: 311971 - DNA, 696 bp, Homo sapiens
  misc_feature: GZ8MTXP02I2VX9.25.36.D03.1.454.CMB.2.raw
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
tcagactgtacagtcacgaccggtgctcgatttagctgcgtcacgatctctcttggggagcttcagctgtggtagagaagacaggattcaggacaatctccagcatggcccggcctcccctctcctcctcacccctcctcactcactgtgcagggtcctgggcccagtctgtgctgactcacgccaccctcagtgtctgggaccccccggnaggagggtctccatctcttnttctgggancagctcgacgtcggaaataagttgtctactggtaccaagcagctaccccgaaagaaacccggcccccaaagcctcctacaagtttacctaaagtaggtaaaattgattaccacgaccggacccgtaccgaaggaacgtaacctcgaaccgtacttcttcgtcggtcgtacgtaaacgtcgtcggtacctcccgttccggcccgtacccgttacggtcccgacgtacctaacgttggggccgtacccggggttccgggaaccgggtacgtacggtacgggactacggtaaacgttaatttaacgttacggttgtaccgtacggtttaacgggtcggttaacgtaccgtacgtacgtacggtacggtcggttccgggtacgggttacgggttacggacgggtaacggaacgtaacgtaacgtacgtaccgtacggtacggtaccgacgaccgtaacgg

SEQ ID NO: 311972 - DNA, 710 bp, Homo sapiens
  misc_feature: GZ8MTXP02G5DNA.25.36.D03.1.454.CMB.2.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (270)..(270): a, c, t, g, unknown or other
  misc_feature (270)..(270): n is a, c, g, or t
  modified_base (410)..(410): a, c, t, g, unknown or other
  misc_feature (410)..(410): n is a, c, g, or t
tcagactgtacagtcacgaccggtgctcgatttagctgcgtcacgatctctcttggggagcttcagctgtggtagagaagacaggattcaggacaatctccagcatggccggcctccctctcctcctcaccctcctcactcactgtgtagggtcctgggcccagtctgtgctgactcagccaccctcagtgtcgtcgggaccccccggnagacgggtctccatctcttgttctgggancagctcgacgtgaaatagttgctagtgtaccngcagcctccaagaaaccggccccaagcctcctcactactataaggatgatcgacgcgccctagaggactaccgtagaccgattccgtacgtcggcctacgaacgttcgtacgggtccttcccgtcgggtacccctcccgngggtacccctagtcgtaacgggtcgggtcccttcccggggtacccgaagggtacgtcgggaggtaccgttaggaaactttaacgtttacgtggttaccgtacgttaaggggtttttggggaactacggtcccgtaaacggtttcgttacggtaaccggttcggggtacccggggtttacggggtaccgggtttccgggaaaccgggggtaggtaaaaccccctggttacggaaccccggtacccggttttacccgggacggttaaccgaccggtttacccccggaaacgggtttcccccg

SEQ ID NO: 311973 - DNA, 574 bp, Homo sapiens
  misc_feature: GZ8MTXP01EZFM9.39.52.E08.1.454.CMB.2.raw
  modified_base (354)..(354): a, c, t, g, unknown or other
  misc_feature (354)..(354): n is a, c, g, or t
  modified_base (410)..(410): a, c, t, g, unknown or other
  misc_feature (410)..(410): n is a, c, g, or t
tcagtcgcactagtcacgaccggtgctcgatttagtcgagctctcagagagaaagggggacccagtcaggacacagcatggacatgagagtcctcgctcagctcctggggctcctgctgctctgtttcccaggtgccaaatgtgacatccagatgacccagtctccagactcactgtctgcatctgtaggagacagagtcaccatcacttgtcgggcgagtcaggtatattagtatttattagcctggattcaacacaaagcgaggggacgaccccaaaatccctgacttcatgctgtcttacctaatttgactaaagtggacgtacccgtacaaagttcagtcggcaagtggntcgtggcacactattcactctcaccatacaaattatttcgactagcctagaacgtnttacgtaggttaattttattaactgtacaacctaaattacttaaacggtaccttttccccctataaccgtttcccggacccttaacggggaacccttaaaggtcggttactccgtaacaaacgttacgttgtaaggctaacgcctaacttctcgttcgttaacc

SEQ ID NO: 311974 - DNA, 641 bp, Homo sapiens
  misc_feature: GZ8MTXP01CRFR0.39.52.E08.1.454.CMB.2.raw
  modified_base (192)..(192): a, c, t, g, unknown or other
  misc_feature (192)..(192): n is a, c, g, or t
tcagtcgcactagtcacgaccggtgctcgatttagtcgagctctcagagagaaagggggacccagtcaggacacagcatggacatgagagtcctcgctcagctcctggggctcctgctgctctgtttcccaggtgccaaatgtgacatccagatgacccagtctccagactcactgtctgcatctgtagganacagagtcaccatctacgttggtcgggcgagtcaggtattattagtatttattagctgatacaacacaaagcgagggacgaccccaaaatccctagatcatgctgtctttaccaatttcgactaaaggtcggacgtcccgtaacgaaaggttcgagccggacaaagggttcgaactcgtgggaccacgtactattacactctacacctagtactaaattaattcgactacgtcctagaatattacgtaggttaattttaactacgttacgtacctaaacctaagttaacttaacgttaacccgtttcccccttacttacccggtttccggccccgttaaggggtaaacccttaaagggtttaccggaactttaaacccgtaacttaaaaaccggttacgttcggtaacgggtacttcggaccctaccttacgttcctttcgtttaaccc

SEQ ID NO: 311975 - DNA, 615 bp, Homo sapiens
  misc_feature: GZ8MTXP01EC7NH.39.52.E08.1.454.CMB.2.raw
  modified_base (217)..(217): a, c, t, g, unknown or other
  misc_feature (217)..(217): n is a, c, g, or t
tcagtcgcactagtcacgaccggtgctcgatttagtcgagctctcagagagaaagggggacccagtcaggacacagcatggacatgagagtcctcgctcagctcctggggctcctgctgctctgtttcccaggtgccaaatgtgacatccagatgacccagtctccagactcactgtctgcatctgtaggagacagagtcaccatcacttgtcgggnagtcaggtattattagtatttattagcctgatcaacacaaagcgagggacgaccccaaatccctagattcatgctgtctttacaatttgactaaagtggacgtaccgtacaaagttcgagcgcaagtagctcgtggccacgactacttcactctacacctatactaattaatttacgactacggtcctagtaagtactttacgttaggttaaacttttacgttacttacgtacctaaaccttaaattaacgttaacgttaccgttttccccctacgttaccgtttcccgggaccccgttaagggtaaacccttaaaggttacggttaacttaaccgtaaccgttaaaacggttccgttaggtcgggtctcgtactacccttatccctttgtttaaccc

SEQ ID NO: 311976 - DNA, 526 bp, Homo sapiens
  misc_feature: GZ8MTXP01EL6ML.39.52.E08.1.454.CMB.2.raw
  modified_base (252)..(252): a, c, t, g, unknown or other
  misc_feature (252)..(252): n is a, c, g, or t
  modified_base (442)..(442): a, c, t, g, unknown or other
  misc_feature (442)..(442): n is a, c, g, or t
  modified_base (516)..(516): a, c, t, g, unknown or other
  misc_feature (516)..(516): n is a, c, g, or t
tcagtcgcactagtcacgaccggtgctcgatttagtcgagctctcagagagaaagggggacccagtcaggacacagcatggacatgagagtcctcgctcagctcctggggctcctgctgctctgtttcccaggtgccaaatgtgacatccagatgacccagtctccagactcactgtctgcatctgtaggagacagagtcaccatcacttgcgggcagtcaggattattagtatttattagctgatcaacanaaagcgagggacgaccccaaatccctgattcatgctgtcttccaatttgacaaagtgacgtccgtacaaagttcgagcgcaaggtggaatcgtggacacactattcactctacacatacaattagtttgctagcctagaacgtattctaggtaatttatactgtacaactaatataataccgtttccccntacgtttccggccgtaagggaaccttaaaggtcgttactctaacaaacgttacgttgtaacggctaagccaacntcttgtttcc

SEQ ID NO: 311977 - DNA, 620 bp, Homo sapiens
  misc_feature: GZ8MTXP01ESONI.39.52.E08.1.454.CMB.2.raw
tcagtcgcactagtcacgaccggtgctcgatttagtcgagctctcagagagaaagggggacccagtcaggacacagcatggacatgagagtcctcgctcagctcctggggctcctgctgctctgtttcccaggtgccaaatgtgacatccagatgacccagtctccagactcactgtctgcatctgtaggagacagagtcaccatcacttgtcgggcagtcaggtatattagtattattgctgatcaacacaaagcgagggacgaccccaaatccctagatcatgctgtcttacctaatttgactaaaggtggacgtcccgtactaaacgttcaggcgactaaggtggaatcgtaggccactactacttcactctacacctatacgtaaattagtttcgactagtacctagtaagtatttactaggttaaattttacgttaactcgttacctaaacgtaaattaacgtttaaacggttacccttttaccccctacgttaacccgtttcccgggaaccccggtaacggggtaaaccttaaacggggtacgttactaccgtaacgttaaaaccgttcttggtaacggtctaacggacctaccgttattccgtttcgttaacc

SEQ ID NO: 311978 - DNA, 577 bp, Homo sapiens
  misc_feature: GZ8MTXP02I6M67.39.52.E08.1.454.CMB.2.raw
  modified_base (280)..(280): a, c, t, g, unknown or other
  misc_feature (280)..(280): n is a, c, g, or t
  modified_base (339)..(339): a, c, t, g, unknown or other
  misc_feature (339)..(339): n is a, c, g, or t
tcagtcgcactagtcacgaccggtgctcgatttagtcgagctctcagagagaaagggggacccagtcaggacacagcatggacatgagagtcctcgctcagctcctggggctcctgctgctctgtttcccaggtgccaaatgtgacatccagatgacccagtctccagactcactgtctgcatctgtaggagacagagtcaccatcacttgtcgggcgagtcaggatattagtatttattagcctggattcaacacaagcaggggagaccccaaatcccngattcatgctgcttccaatttgcaaagtggacgtcccgtacaaagttcagcggcagtgntctggcacactatttcactctacaccatacaaattaatttgacagtcctagaaagtatttactaggttaaattttacttactacgttacaacctaaattataaacgttaccgtttacccccctattaacccgtttccggacccgttacggggtaccctaaaaggtcggtaacttacctacgaaaaccgtaacgtaggttaacggacttcggaccaccgtacttccgttacgtttaccc

SEQ ID NO: 311979 - DNA, 564 bp, Homo sapiens
  misc_feature: GZ8MTXP02JI97V.39.52.E08.1.454.CMB.2.raw
  modified_base (469)..(469): a, c, t, g, unknown or other
  misc_feature (469)..(469): n is a, c, g, or t
tcagtcgcactagtcacgaccggtgctcgatttagtcgagctctcccggcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctctgcactggaaccagcagtgacgttggtgttataactatgtctctggtaccaacatccacccaggacaaacgtccccaaactgatgatttatgaggtcaactaaacggcctcgtaggggtttctaatcgtctttcctctggctaccgtaagtcgtagccaaacgacggtccctccctagaccctatcctcgtcggctccgaggctggaggacgacggctactctatttacttgctagctactaatataacagtactattancgtacgttgggtcgttacgggcgggtagggacccgacgtcggaccgttacgttaggcaacgtacccgaagtccgtcgccccctcggtactacccg

SEQ ID NO: 311980 - DNA, 595 bp, Homo sapiens
  misc_feature: GZ8MTXP02HVOKF.39.52.E08.1.454.CMB.2.raw
tcagtcgcactagtcacgaccggtgctcgatttagtcgagctctcagagagaaagggggacccagtcaggacacagcatggacatgagagtcctcgctcagctcctggggctcctgctgctctgtttcccaggtgccaaatgtgacatccagatgacccagtctccagactcactgtctgcatctgtaggagacagagtcaccatcacttggtcgggcgagtcaggatattagtattattagctgatcaacacaagcagggacgaccccaaaatcccctagattcatgactgtcttaccaatttgacaaagtggataccgtacaaagttcagcggacaggtggatcgtaggcacactatttacactctcaacactactaataactttgacagtacctaggaatattacgtaggttaattttacttacttagttaccaactaaattaattaaacgtaccgtttaccccctactaccgttttacccggacccgttacggggaacccttaaaggttacggtaaacttccgtaaacgtaaaaccggtaaaccgtttaggcggtaccttacggacctaacctacgtttcttacgtttccc

SEQ ID NO: 311981 - DNA, 650 bp, Homo sapiens
  misc_feature: GZ8MTXP02G816V.39.52.E08.1.454.CMB.2.raw
tcagtcgcactagtcacgaccggtgctcgatttagtcgagctctcagagagaaagggggacccagtcaggacacagcatggacatgagagtcctcgctcagctcctggggctcctgctgctctgtttcccaggtgccaaatgtgacatccagatgacccagtctccagactcactgtctgcatctgtaggagacgagacgtccaccatctacgttggtcgggcgtagtcgaggtattattagttatttattagcctggtatacaacacaagcggaaggggaccgaccccaaatccctagtactcagtgacgtcgtacttacctaagtttcgaacgtaaaaggttcggtaaccgttcccgtaacgtaaacggttccgacggccggtactaggtcgggtactcgtggacctaccacttactttacacctactaactaactactaagttaacttgactacgcctaaggaactattacgttagttaatttagttactagtacctaactaaataacgtaacgttacccgtttacccctacgttacccgtttaccggtacccgttacgggaaaccctaaggttcgaaccttacgtaaccgtaaaaccgtacgtcggtacggtaacttacgacctacgtacttcgttactacctttc

SEQ ID NO: 311982 - DNA, 594 bp, Homo sapiens
  misc_feature: GZ8MTXP02JV7XU.39.52.E08.1.454.CMB.2.raw
tcagtcgcactagtcacgaccggtgctcgatttagtcgagctctcagagagaaagggggacccagtcaggacacagcatggacatgagagtcctcgctcagctcctggggctcctgctgctctgtttcccaggtgccaaatgtgacatccagatgacccagtctccagactcactgtctgcatctgtaggagacagagtcaccatcacttggtcgggcgagtcaggtatattagtatttattagcctgattcaacacaagcgaggggacgaccccaaaatccctagacttcatgctgtctttacctaatttgactaaagtcggacgtaccgtactaaagttcaggcggacgaggtgactcgtcggacaacactactttcactcctacaacctatacaaattattcgacacgtctagaacgtattacgtagttaaatttacttactgtaccaactaattaagtaacgtaaccctttccccagttaccgtttaccgaccgttacggtaaaccctaaaggttacggtacttaacttaaccgaaaacgtaaccgttggtaaccggtacttacggacctacctacttccgtctttaacc

SEQ ID NO: 311983 - DNA, 728 bp, Homo sapiens
  misc_feature: GZ8MTXP01BHKYO.41.45.E01.1.454.CMB.2.raw
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
tcagtctatactatcacgaccggtgctcgatttagtgagtcagtaagggaaaggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggttcagctggtggagtcgtgggggagcgtggtccagccgtgggaccgtccctgatctctctgtgtcgccgtcgatctagttcagtnactctcgccatcgctacggtcggtcccncgacggcctccggaggcggaagggggcgtggggtagggtgggggtcgactacggtcattcggtcggtctaggtaagttaagggaaaagttaaaaaaagtaacttaacgtaaaggttaaaccgggtaaaacccgtttccgggaaggggtaaaccgggtcccttaacgtttcccgtacccgttacctaacccgaaggtaacgtaaaccttaaaccttaacccgaaacgtaaacccgtacgttaagtaactaaactaaacgtaaagtaactaaacgttaagttacggaagtaccgaccggacggtaaccgtcgtacttcgttacttattaacgttacgacgtacttaccgtagttccgttacgttaccgggttcgggaaccgacgggtccgtcccgtcggttaccctaaccgttccctaacccg

SEQ ID NO: 311984 - DNA, 400 bp, Homo sapiens
  misc_feature: GZ8MTXP02IIP4F.41.45.E01.1.454.CMB.2.raw
  modified_base (388)..(388): a, c, t, g, unknown or other
  misc_feature (388)..(388): n is a, c, g, or t
  modified_base (394)..(400): a, c, t, g, unknown or other
  misc_feature (394)..(400): n is a, c, g, or t
tcagtctatactatcacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccacaggcccatcggtctcccctggcgccctgctccaggacgcacctccgagagcacagccggccctgggctgcctggtcaggcctactcctatatactgtctgagcgggctggcaaggcncatagnnnnnnn

SEQ ID NO: 311985 - DNA, 565 bp, Homo sapiens
  misc_feature: GZ8MTXP02GKLDW.41.45.E01.1.454.CMB.2.raw
  modified_base (300)..(300): a, c, t, g, unknown or other
  misc_feature (300)..(300): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (418)..(418): a, c, t, g, unknown or other
  misc_feature (418)..(418): n is a, c, g, or t
tcagtctatactatcacgaccggtgctcgatttagtgagtcagtaagggaaaggggctgggagaggagcccagcactagaagtcggcggtgtttccattcggtgatcagcactgaacacagaggactcaccatggagtttgggctgagctgggtttcctcgttactctttaagaggtgtccagtgtcaggtgcacctggtggagtcgtgggggaggcgtggtccagcctggggaggtccctgagactctcctgtgagcctctggatttagttcagtagtctggcatgcacgtgggtcccnccaggcctccgagggcgaaagggggcccgaggtcgggttggcagtttanagcaatatgatggtaacttnagattattatcggacagtaccgtccgtagaacggggcctattccaaccnttacaccagaacgacaacgttcccggaaactactcgtacgtacctaggaaatcgatcagtccaggagacggcgacggtctcggctcgtagtatctgtcgacgtacgagtcggggaagtcggacaggaccaggactagttacgtcggg

SEQ ID NO: 311986 - DNA, 583 bp, Homo sapiens
  misc_feature: GZ8MTXP02G00E0.41.45.E01.1.454.CMB.2.raw
  modified_base (264)..(264): a, c, t, g, unknown or other
  misc_feature (264)..(264): n is a, c, g, or t
  modified_base (304)..(304): a, c, t, g, unknown or other
  misc_feature (304)..(304): n is a, c, g, or t
tcagtctatactatcacgaccggtgctcgatttagtgagtcagtaagggaaaggggctgggagaggagcccagcactagaagtcggcggtgtttccattcggtgatcagcactgaacacagaggactcaccatggagtttgggctgagcgtgggttttcctcgttactcttttaagaggtgtccagtgtcaggtgcacctggtggagtcgtgggggaggcgtggtccagcctgggaggtccctgagactctcctgtgaagcctntggatttagttcagtagttctggcatgcacgtgggtcccnccaggcctccgaggcgaagggggccggagtcgggttggctaggttatagcatatgacgtggtaacttcgtaagtattattatgacagtacctccgtaggaaacggggcctaattccaccattccaccgagacgactaacttaccccggaaactacctactacgtaacctaggaaatgtatcacgcctagagaggacgacggacgtcggcttcgtagtacgttactcggtgacggagtacgtggggaaagtcggacagacaggtacttagtacggtcggg

SEQ ID NO: 311987 - DNA, 594 bp, Homo sapiens
  misc_feature: GZ8MTXP02JCF2P.41.45.E01.1.454.CMB.2.raw
  modified_base (298)..(298): a, c, t, g, unknown or other
  misc_feature (298)..(298): n is a, c, g, or t
tcagtctatactatcacgaccggtgctcgatttagtgagtcagtaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggttcagctggtggagtcgtgggggagcgtggtccagcctgggactcctgagctctcctgtgttgcgtccggatcagtttcagtgactctgccatgcacgtcggtccncaggctccgaggcgaaggggctgggacgtggggtgcagtcagttcgtggtctagataggaaagtaaagatacgtagtaggaaaacctccgtaggaacggccgtattccgtccgtctaccgagagacaattaccaagaacacgtatactactaacaaagtcaaactattagaagacgaccgaggactcggactctatatttagtacgtacgacgtcccctaagttccgttacgtaaccggttcggggaacccgtaaggggaccgtacccgtgggttaccctacccggtcccttcccg

SEQ ID NO: 311988 - DNA, 625 bp, Homo sapiens
  misc_feature: GZ8MTXP01DP0PP.39.53.E09.1.454.CMB.2.raw
tcagtcgcactagtcacgaccggtgctcgatttagagagagtgtgttggggtttgggggaagaggaagactgacggtcctgcaactggtggcgtctgggggaggcttggtccagcctggggggtccctgagactctcctgtacagcctctggattcaggtttagtgacgcctggataaactgggtccgccaggctccagggaaggggctggagtgggtcgccaacattaagaaagatggaagtgaagaaaaactatgtggactctgtgaagggccggtttacatctcagggacaacgccatgcatttagcatatttgcaaaataaacagtctgagagccgaggacacggcttcatatcactgtgcgctgggggcaactatggattcgtggggccaaggggaccacgggtcaccgtctcctcacgcctacccaccgaaacgggccccaatccgggtccttcccccgtggccgccccgtcgcctccagggacgccaacccgtccggaacgcggccacgacggcccggccccgttggggccttcggcccgttagggtccaaaacggggttaccttaaccgtttcccaacgttaacggtcggaccgttaacgtcggaacggcccggggg

SEQ ID NO: 311989 - DNA, 570 bp, Homo sapiens
  misc_feature: GZ8MTXP01BGUS8.39.53.E09.1.454.CMB.2.raw
  modified_base (347)..(347): a, c, t, g, unknown or other
  misc_feature (347)..(347): n is a, c, g, or t
tcagtcgcactagtcacgaccggtgctcgatttagagagagtgtgttggggtttgggggaagaggaagactgacggtcctgcaactggtggcgtctgggggaggcttggtccagcctggggggtccctgagactctcctgtacagcctctggattcaggtttagtgacgcctggataaactgggtccgccaggctccagggaagggctggagtgggtcgccaacattaagaaagatggaagtgaagaaaaactatgtggactctgtgagggccgtttacatctcaggacaacgcatgcattagcatatttgacaaataaacagtctgagagccgaggacacggcttnatatcactgtgcgcgtgggggcaactatggattcgtggggaccaagggaccacggtcaccgtctcctcacgcctccaccgaacgggcccacgtccggtccttcccccgtgcccgcccgtcgctcccgaggcgcaccgtccgagacgcacgacggccgcccgtgggcctcgccgtggtcacggttcttaccttccacgtaacgtcgccgacgtcgaaggccggg

SEQ ID NO: 311990 - DNA, 591 bp, Homo sapiens
  misc_feature: GZ8MTXP01AUY24.39.53.E09.1.454.CMB.2.raw
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (516)..(516): a, c, t, g, unknown or other
  misc_feature (516)..(516): n is a, c, g, or t
  modified_base (572)..(572): a, c, t, g, unknown or other
  misc_feature (572)..(572): n is a, c, g, or t
tcagtcgcactagtcacgaccggtgctcgatttagagagagtgtgttggggtttggggggaagaggaagactgacggtcctgcaactggtggcgtctgggggaggcttggtccagcctgggggggtccctgagactctcctgtacagcctctggattcaggtttagtgacgcctggataaactgggtccgccaggctccgaggggaaggggctggagtgggtcgccaaacattaagaaagatggaagtgaagaaaaactatgtggactctgtaggaagggtccggtttaccatctccgagggacaacgccatgactatttagctatatttgacaaaataaacagtctagagagccgaggacacggtctacatancactgtgcgcgtgggcaatagtgattcgnggggaccaaggggaccacggtcaccgttctcctacacgcctccgaaccaacggggccctagtccggttcctccccgtgccgccgtcgctccagggaccgccacccgcgagacncacgcgcggcctgggctcgcgtaggtcgaaacggttccttaccttccagttaacgngtccgactggaacgcgggg

SEQ ID NO: 311991 - DNA, 840 bp, Homo sapiens
  misc_feature: GZ8MTXP01AXJ5U.39.53.E09.1.454.CMB.2.raw
tcagtcgcactagtcacgaccggtgctcgatttagagagagtgtgttggggtttgggggaagaggaagactgacggtcctgcaactggtggcgtctgggggaggcttggtccagcctgggggggtccctgagactctcctgtacagcctctggattcaggtttagtgacgcctggataaactgggtccgccaggctccgagggaaggggctggagtgggtcgccaacattaagaaagatggaagtgaagaaaaactatgtggactctgtgaagggccggttaccatctccagggacaacgcatgctattagcatattgacaaataaacagtctgaagagccgaggacacggtcttacatatcactgtgacgcgtggggcaaacgttagtggtaatttcgggtacgggggacccgaaaacggggaccccgtaaccgggtcccgtaacccgttccttaccccgttacgaaccgggtacccccttaccccgaaacccggaaaccggggtaccccctaacgttaccccgggttccccgtttcccccccgttcgggaccccgtcccccggtttcgggcccctttacccggaaccggggtaacgggcccctaaccccgttacccggaaaccggaacccggtacccgtaaaaccccggaccgggtccccggggaacccccgggttacgggggttccccggttaccggttccccgggttttaaccggggaacccggttaaaacccgggggttaacccttttaaaccccgttttaaccccgaaacggtttaaaccgggttccgggtaccccgggaaacccgtttgggggaacccggggtccccgggggg

SEQ ID NO: 311992 - DNA, 624 bp, Homo sapiens
  misc_feature: GZ8MTXP01DKH2H.39.53.E09.1.454.CMB.2.raw
tcagtcgcactagtcacgaccggtgctcgatttagagagagtgtgttgggtttggggtcagagaggagccctagccctggactccaaggcctttccacttggtgatcagcactgagcacagaggactcaccatggaattggggctgagctgggttttccttgttgctatttagaaggtgtccaatgtgaggcgcaactggtggcgtcgtggggggaggcttggtccagccgtggggggtccctgagactctcctgtacagcctctgggattcgtaggtttagtgacgcctggataaacgtgggtccgccaggctccgaggggagggctgggagtgggtcgccaacaattaagaaagataggaagtagaacgaaaaactatgtggactcgtggtggaaaggggtcccgggtttaaccatcctaccgaggggaacaacgccatgactatttagactattatttacgactaaaataaacagtactagggagacggaccgaaggactacggcttcaagtctcatggtgcgtcgttgggggcttacgtagtgggttacgtttcggcgggggtaacccgaaacgggggaacccgtaccgggtccgaaccgttccgttccccgttaacccg

SEQ ID NO: 311993 - DNA, 253 bp, Homo sapiens
  misc_feature: GZ8MTXP02IRUSG.39.53.E09.1.454.CMB.2.raw
  modified_base (252)..(253): a, c, t, g, unknown or other
  misc_feature (252)..(253): n is a, c, g, or t
tcagtcgcactagtcacgaccggtgctcgatttagagagagtgtgttgggtttgggacagatttcactctcaccatcagcagcctgctgcctgaagatgctgcaacttattactgtcaaaagtatgacagtgtcccgtggacgttcggcccagggaccaaggtggaaatcaaacgaactgtggctgcaccatctgtcttcatcttccgccatctgaactagtgcgactgagcgggctggcaaggcgcatagnn

SEQ ID NO: 311994 - DNA, 252 bp, Homo sapiens
  misc_feature: GZ8MTXP02H4J8L.39.53.E09.1.454.CMB.2.raw
  modified_base (252)..(252): a, c, t, g, unknown or other
  misc_feature (252)..(252): n is a, c, g, or t
tcagtcgcactagtcacgaccggtgctcgatttagagagagtgtgttgggtttggacagatttcactctcaccatcagcagcctgctgcctgaagatgctgcaacttattactgtcaaaagtatgacagtgtcccgtggacgttcggcccagggaccaaggtggaaatcaaacgaactgtggctgcaccatctgtcttcatcttcccgccatctgaactagtgcgactgagcgggctggcaaggcgcatagn

SEQ ID NO: 311995 - DNA, 616 bp, Homo sapiens
  misc_feature: GZ8MTXP02JWL3L.39.53.E09.1.454.CMB.2.raw
  modified_base (509)..(509): a, c, t, g, unknown or other
  misc_feature (509)..(509): n is a, c, g, or t
tcagtcgcactagtcacgaccggtgctcgatttagagagagtgtgttgggtttggggtcagagaggagccctagccctggactccaaggcctttccacttggtgatcagcactgagcacagaggactcaccatggaattggggctgagctgggttttccttgttgctattttagaaggtgtccaatgtgaggcgcaactggtggcgtcgtgggggaggcttggtccagccgtggggggtccctgagactctcctgtacagcctctggattcaggtttagtgacgcctggataaacgtgggtccgccaggctccgaggggaaggggcgtggaggtgggtcgaccaaacattaaagaaagatagggaagtagaaacgaaaaactagtgtaggactcgtggtggaaggggtccggtttaccatcctacgagggaccaacgccatgactatttagctaatatttagactaaaataaacagtactaggagagcgagggacacggcttacattanctacgtgtcgcgcgtggggacctaacgttagtggtacgttccggtacgggggaacccgaaaacgggggtacccgaaccgggttaccaccccggttcctaccctaccg

SEQ ID NO: 311996 - DNA, 628 bp, Homo sapiens
  misc_feature: GZ8MTXP02IFCTU.39.53.E09.1.454.CMB.2.raw
  modified_base (430)..(430): a, c, t, g, unknown or other
  misc_feature (430)..(430): n is a, c, g, or t
  modified_base (475)..(475): a, c, t, g, unknown or other
  misc_feature (475)..(475): n is a, c, g, or t
  modified_base (508)..(508): a, c, t, g, unknown or other
  misc_feature (508)..(508): n is a, c, g, or t
tcagtcgcactagtcacgaccggtgctcgatttagagagagtgtgttggggtttggggggaagaggaagactgacggtcctgcaactggtggcgtctgggggaggcttggtccagcctggggggtccctgagactctcctgtacagcctctggattcaggtttagtgacgcctggataaactgggtccgccaggctccgagggaaggggctggagtgggtcgccaacattaagaaagatggaagtgaagaaaaactatgtggactctgtgaagggtccgttacatctcagggacaacgccatgctattagcatatttgacaaataaacagtctagagagccgaggacacggtcttcatatcactgtgcgcgtggggcacgtatggtattcgtggggaccgaaggggacccacgtccaccgttctccctcncgccctccaaccgaacgggccctacgtcccggtcccttcccccgnggccccgtcccgtcgtccctacccgacgggacncccgacccgtccgaacgacgaccacgacggcccggcccgtgggcctcgtcccgtacgggttaccgaacggtaccttaccttaaccgaacgtacggtcgaccgtacgtcggacggccgggg

SEQ ID NO: 311997 - DNA, 609 bp, Homo sapiens
  misc_feature: GZ8MTXP02IDOIF.39.53.E09.1.454.CMB.2.raw
  modified_base (257)..(257): a, c, t, g, unknown or other
  misc_feature (257)..(257): n is a, c, g, or t
  modified_base (492)..(492): a, c, t, g, unknown or other
  misc_feature (492)..(492): n is a, c, g, or t
tcagtcgcactagtcacgaccggtgctcgatttagagagagtgtgttgggtttggggtcagagaggagccctagccctggactccaaggcctttccacttggtgatcagcactgagcacagaggactcaccatggaattggggctgagctgggttttccttgttgctattttagaaggtgtccaatgtgaggcgcaactggtggcgtctgggggaggcttggtccagccgtgggggtccctgagactctcctgtacngcctctggattcaggtttagtgacgcctggataacgtggtccgcgaggctccgaggggaagggctggagtgggtcgaccaacattaaagaaagagtaggaagtgaaacgaaaaactatagtaggactcgtgtggaacgggtccggtttaccatcctaccgagggtaccaaactacccatcgactagtttagactattattagactaaaataaacagtactagagagacgaggacncggactacatatcacgtgtacgcgtcgtcgggggactacgtagtcggtacgtttacggtacgggggaacccgaacggggtacccgaccgggtaccgacccggttacctaccctcccg

SEQ ID NO: 311998 - DNA, 538 bp, Homo sapiens
  misc_feature: GZ8MTXP02JH7KC.39.53.E09.1.454.CMB.2.raw
  modified_base (341)..(341): a, c, t, g, unknown or other
  misc_feature (341)..(341): n is a, c, g, or t
  modified_base (502)..(503): a, c, t, g, unknown or other
  misc_feature (502)..(503): n is a, c, g, or t
tcagtcgcactagtcacgaccggtgctcgatttagagagagtgtgttgggtttggggtcagagaggagccctagccctggactccaaggcctttccacttggtgatcagcactgagcacagaggactcaccatggaattggggctgagctgggttttccttgttgctattttagaaggtgtccaatgtgaggcgcaactggtggagtcgtgggggaggcttggtccagccgtggggggtccctgagactctcctgtgcagcctctggattcacctttaggaactattggatgagttgggtccgccaggctgcaggggaaggggctggagtgggtggccaanataggaggtagagtggaagagagaaaatactatgtggactctgtgaagggccattcaccatctccagagacaacgccaagaattcactgtaatttacaaaatgaacagcctagagagcgaggacacgtctgtatactattgtgcggaaagggggcaggtgnngggctacgtggggccgacgggaacccggtcacccg

SEQ ID NO: 311999 - DNA, 566 bp, Homo sapiens
  misc_feature: GZ8MTXP02G2RG3.39.53.E09.1.454.CMB.2.raw
tcagtcgcactagtcacgaccggtgctcgatttagagagagtgtgttgggtttggggtcagagaggagccctagccctggactccaaggcctttccacttggtgatcagcactgagcacagaggactcaccatggaattggggctgagctgggttttccttgttgctattttagaaggtgtccaatgtgaggcgcaactggtggcgtctgggggaggcttggtccagcctgggggtccctgagactctcctgtacagcctctggattcaggtttagtgacgcctggataaactgggtccgccaggctccgaggggaaggggctggagtgggtcgccaacattaagaaagatggaaagtgaagaaaaactatgtaggactcgtgtggaacggggtccggtttacagtctacgagggacaacgccaatgctatttagactatatttgactaaaataaacagtctagagagccgaggacacggctacatactcactgtgcgcgtggggcacgtatggacttcgtcggggccgtaagggacccgacggtaccacccggtctaccgtaccg

SEQ ID NO: 312000 - DNA, 573 bp, Homo sapiens
  misc_feature: GZ8MTXP02GMHQH.39.53.E09.1.454.CMB.2.raw
  modified_base (259)..(259): a, c, t, g, unknown or other
  misc_feature (259)..(259): n is a, c, g, or t
  modified_base (462)..(462): a, c, t, g, unknown or other
  misc_feature (462)..(462): n is a, c, g, or t
  modified_base (490)..(490): a, c, t, g, unknown or other
  misc_feature (490)..(490): n is a, c, g, or t
tcagtcgcactagtcacgaccggtgctcgatttagagagagtgtgttgggtttggggtcagagaggagccctagccctggactccaaggcctttccacttggtgatcagcactgagcacagaggactcaccatggaattggggctgagctgggttttccttgttgctattttagaaggtgtccaatgtgaggcgcaactgggtggcgtcgtgggggaggcttggtccagccgtgggggtccctgagactctcctgtacngcctctggattcaggtttagtgacgcctggataaactgggtccgccaggctccaggggaaggggctggagtggggtcgccaacattaaagaaagagtaggaaagtgaagaaaaactatagtaggactcgtggtggaaggggtccggtttaccatcctccgagggacaacgcatgcattagcatatttgacaaataaacagtcngagagaccgaggacgacggcttcatacncaacgtgtcgcgcgtggggctacgtacgtggacttcggtaggggaaccgaacgggaccgaccggtcctaccgtcctcctaccg

SEQ ID NO: 312001 - DNA, 558 bp, Homo sapiens
  misc_feature: GZ8MTXP02JBCLG.39.53.E09.1.454.CMB.2.raw
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
tcagtcgcactagtcacgaccggtgctcgatttagagagagtgtgttgggtttggggtcagagaggagccctagccctggactccaaggcctttccacttggtgatcagcactgagcacagaggactcaccatggaattggggctgagctgggttttccttgttgctattttagaaggtgtccaatgtgaggcgcaactggtggcgtcgtgggggaggcttggtccagcctggggggtccctgagactctcctgtacagcctctggattcaggttagtgacgcctggataaactgggtccgccaggctccgaggggaaggggctggagtgggtcgccaacattaagaaagatggaagtgaagaaaactntagtggactctgtgagggtccgttacntctcgaggacaacgccatgcattagcatattgactaaataaacagtctagagtagccgagggacacggcttacgatactcacgtgtcgcgcgtggggactacgtagtcggacttcgtcggggaaccgaacggggacccacggggtacacccggtctccgtcg

SEQ ID NO: 312002 - DNA, 568 bp, Homo sapiens
  misc_feature: GZ8MTXP02FGQJF.39.53.E09.1.454.CMB.2.raw
  modified_base (188)..(188): a, c, t, g, unknown or other
  misc_feature (188)..(188): n is a, c, g, or t
  modified_base (206)..(206): a, c, t, g, unknown or other
  misc_feature (206)..(206): n is a, c, g, or t
  modified_base (258)..(258): a, c, t, g, unknown or other
  misc_feature (258)..(258): n is a, c, g, or t
  modified_base (298)..(298): a, c, t, g, unknown or other
  misc_feature (298)..(298): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (478)..(478): a, c, t, g, unknown or other
  misc_feature (478)..(478): n is a, c, g, or t
tcagtcgcactagtcacgaccggtgctcgatttagagagagtgtgttgggtttggggtcagagaggagccctagccctggactccaaggcctttccacttggtgatcagcactgagcacagaggactcaccatggaattggggctgagctgggttttcctgttgctattttagaaggtgtccaatgtnaggcgcaactgtgcgtcnggggaggcttggtccagccgtgggggtccctgagactctcctgtacagcctntggattcaggtttagtgacgcctggataaactggggtccnccaggcctccaggggaaaggggctgggagtggggtcnccaacattaagaaagntggaaagtgagaaaacctatgtggactctgtgagggcggtttaccatctcagggacaaacgccgatgcattacgcaattatttgacaaaataaaaccgngtcaganacgccgaaggacacgtactanatactcgacgtgcgcgcggtcgggactacgtagtcgtacttcggtacggggaaccgaacggggacccgtacggtccaccgtcctcctacg

SEQ ID NO: 312003 - DNA, 657 bp, Homo sapiens
  misc_feature: GZ8MTXP02JYQ8O.39.53.E09.1.454.CMB.2.raw
  modified_base (257)..(257): a, c, t, g, unknown or other
  misc_feature (257)..(257): n is a, c, g, or t
tcagtcgcactagtcacgaccggtgctcgatttagagagagtgtgttggggtttgggggaagaggaagactgacggtcctgcaactggtggcgtctgggggaggcttggtccagcctggggggtccctgagactctcctgtacagcctctggattcaggtttagtgacgcctggataaactgggtccgccaggctccgagggaaggggctggagtgggtcgccaacattaaagaaagatggaagtgaagaaaaactntgtggactctgtgaagggtccgtttaccatctcgagggacaacgcatgcattagcatatttgacaaataaacagtctgagagccgaggacacggcttcgaatactcaactcgtagccgtcgtggggctacgtatgggtacttcggtcggggaccaacgggggacctacgggtcctaccgtcctcctcgacgccctcccgaacctacgggcccacgtccgtccctccccgtaggccctccgtcgacctccgacggacgaccaaccgttccggaacgcgaccacgaccggccggtaccccgtcggggcccgttcggtacccgtcggggtaacccaacggggtaacccttacgtaaccccgtacgtttacggacgtccggtaccgttaggacgggtcccgggg

SEQ ID NO: 312004 - DNA, 743 bp, Homo sapiens
  misc_feature: GZ8MTXP02GZQUL.39.53.E09.1.454.CMB.2.raw
  modified_base (257)..(257): a, c, t, g, unknown or other
  misc_feature (257)..(257): n is a, c, g, or t
tcagtcgcactagtcacgaccggtgctcgatttagagagagtgtgttgggtttggggtcagagaggagccctagccctggactccaaggcctttccacttggtgatcagcactgagcacagaggactcaccatggaattggggctgagctgggttttccttgttgctattttagaaggtgtccaatgtgaggcgcaactggtggcgtcgtgggggagcttggtccagccgtgggggtccctgagactctcctgtacngcctctggattcgaggtttagtcgacgcctggaactaaacgtcgggtcccgccgaggcctacccgaagggggaacggggcgtggggtaaggtcggggtccgacccgaaaactaaagtttaaaacggaaaaggacgtagggaaaggtagaaaacgtaaaaaactagtaggtacggacttcgttaggtacggggtaaacgggggttacccggtttaaccaacgttcccgtaccggaaacggggtaacccaaaccggccctaaagtcgtaccgtaagttttacgactattaacgtttacgtaaactaaaaacttaaaacgaagttaccgtaggaaaggtacgaccggaacgggaaccacgggtaccttacaatacttactacgtgtacggcgtcggtacggggcctaacgtagtcggtacgttaccgggacggggtaaccgaaacggggacccgtaccggtacccgtaacccgtccttacccgtacccg

SEQ ID NO: 312005 - DNA, 617 bp, Homo sapiens
  misc_feature: GZ8MTXP01ATSF4.52.9.A09.1.454.CMB.2.raw
  modified_base (226)..(226): a, c, t, g, unknown or other
  misc_feature (226)..(226): n is a, c, g, or t
tcagcgcagtacgacacgaccggtgctcgatttagcgagacgcgcagggaggatggagactggggctcctgctactctggctccgaggtgccagatgtgacatccagatgacccagtctccatcctccctgtctgcatctgtaggagacagagtcaccatcacttgccgggcaagtcagagcattagcagcttaatttaaatggtatcagcagagccaagggaacnccctaaactcctgactctctgctgcattctagtttgcatactgacgtcccatccaggttcagtggcggtgatcgtggacagtactttcacctctacaccgatcaacgctaaggtctagacctaaaccgtgtaacgtattttacgactaacttactactagtacaaacgtacgggttaccgaaccctgtactacgaagttccgttacggggacgggggtaacggggaccgaaaggggttacgggaacgtaacgtaaccgaaaaccggtagttcggtacggtctacggaccctaacctaattccgtttacgttcccgtttacctaaccggtttccctttccccggaccttaacttcctaaggtaacttacggttaactccgttccggtaacgg

SEQ ID NO: 312006 - DNA, 515 bp, Homo sapiens
  misc_feature: GZ8MTXP01BRLI5.52.9.A09.1.454.CMB.2.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (266)..(266): a, c, t, g, unknown or other
  misc_feature (266)..(266): n is a, c, g, or t
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (399)..(399): a, c, t, g, unknown or other
  misc_feature (399)..(399): n is a, c, g, or t
  modified_base (451)..(451): a, c, t, g, unknown or other
  misc_feature (451)..(451): n is a, c, g, or t
  modified_base (465)..(465): a, c, t, g, unknown or other
  misc_feature (465)..(465): n is a, c, g, or t
  modified_base (487)..(487): a, c, t, g, unknown or other
  misc_feature (487)..(487): n is a, c, g, or t
tcagcgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccggnaagtcagngcattagcagctattaatggtatcagcagaagccgaagggaaacncccctaaatcctgactctactgctgctatcttagttgctatacctgacgtccagtcaaggttcnggtggcggtgatcgtgggactagtntttcnctctcacctatacagctacgtctgaccaactgaaggttntttacgactaaactttactacgtgtactaacggtacgtaccgaactcgactntacttcgtacgggnggacggtacagggttgagtaanacgtaacgacgtggttcgcgttcgaacc

SEQ ID NO: 312007 - DNA, 425 bp, Homo sapiens
  misc_feature: GZ8MTXP01CCJ4I.52.9.A09.1.454.CMB.2.raw
  modified_base (171)..(171): a, c, t, g, unknown or other
  misc_feature (171)..(171): n is a, c, g, or t
  modified_base (190)..(190): a, c, t, g, unknown or other
  misc_feature (190)..(190): n is a, c, g, or t
  modified_base (230)..(230): a, c, t, g, unknown or other
  misc_feature (230)..(230): n is a, c, g, or t
  modified_base (237)..(242): a, c, t, g, unknown or other
  misc_feature (237)..(242): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (248)..(249): a, c, t, g, unknown or other
  misc_feature (248)..(249): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (274)..(276): a, c, t, g, unknown or other
  misc_feature (274)..(276): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (385)..(387): a, c, t, g, unknown or other
  misc_feature (385)..(387): n is a, c, g, or t
  modified_base (389)..(390): a, c, t, g, unknown or other
  misc_feature (389)..(390): n is a, c, g, or t
  modified_base (392)..(392): a, c, t, g, unknown or other
  misc_feature (392)..(392): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (412)..(413): a, c, t, g, unknown or other
  misc_feature (412)..(413): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
tcagcgcagtacgacacgaccggtgctcgatttagcgagacgcgcagggaggatggagactggggctcctgctactctggctccgaggtgccagatgtgacatccagatgacccagtctccatcctccctgtctgcatctgtaggagacagagtcaccatcacttgccggnaagtcagagcattagcagntaatttaaatggtatcagcagaagcagggaaatcctaaanctgatcnnnnnntntntnnatangngtcncncngtngngngngnnnganatatnaccncnacancaancntctnacacatatatntactactatactatanacgagtacgacncncncatcgtgcggggaggagagagagananaacgangtgcnnncnntnttctctcttcttcncntntnntanactcgcgng

SEQ ID NO: 312008 - DNA, 559 bp, Homo sapiens
  misc_feature: GZ8MTXP01BRJLO.52.9.A09.1.454.CMB.2.raw
  modified_base (226)..(226): a, c, t, g, unknown or other
  misc_feature (226)..(226): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (489)..(489): a, c, t, g, unknown or other
  misc_feature (489)..(489): n is a, c, g, or t
tcagcgcagtacgacacgaccggtgctcgatttagcgagacgcgcagggaggatggagactggggctcctgctactctggctccgaggtgccagatgtgacatccagatgacccagtctccatcctccctgtctgcatctgtaggagacagagtcaccatcacttgccgggcaagtcagagcattagcagcttatttaaatggtatcagcagaagccaagggaacnccctaaatctgatctctgctgcattctagtttgctatactgacgtcccatccgaggttcaggtcggcggtggactcgtagggactagtactttcgaccctctacaccatcgaagacngtcngaccaacctgaagtatttgacttaacttactactgtactaacgtacgggttaccgaaccttgcctcactcgttacgggacggggaacgggtaccgtaagggtcgaagtactacgaaacgtacgtgtcggctcgcctaacctnttcgttcgttcctaccgtacttccccgttcccgactaacttacgtaagtactacgttacgtcgttcgtcg

SEQ ID NO: 312009 - DNA, 550 bp, Homo sapiens
  misc_feature: GZ8MTXP01DJBYM.52.9.A09.1.454.CMB.2.raw
  modified_base (216)..(216): a, c, t, g, unknown or other
  misc_feature (216)..(216): n is a, c, g, or t
  modified_base (344)..(344): a, c, t, g, unknown or other
  misc_feature (344)..(344): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
tcagcgcagtacgacacgaccggtgctcgatttagcgagacgcgcaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagtcttatttaaatggtatcagcaagaacgccgaagggaaacgcccctaaactcctagactctctgctgctattcttagttgctatacctgacgtcccatcccgaaggttcnggtgggcggtggactcgtaggggactagtactttcactctacaccatcagctagtcncgacaactagaagttnttttagacttaaacttactactgtacaaacgtacgggttaaccgaccctgctctacttcgttacgggcgggtaaggaaccgagggttggaacgtaataaacgaaacgtacgtggttacggtaacttcgaaccc

SEQ ID NO: 312010 - DNA, 604 bp, Homo sapiens
  misc_feature: GZ8MTXP01DWWKQ.52.9.A09.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (455)..(455): a, c, t, g, unknown or other
  misc_feature (455)..(455): n is a, c, g, or t
tcagcgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatgacccagtctccatccctccctgtctgcatctgtagganacagatcaccatcacttgccggganaagtcagagctaattagcagtctaatttaaagtggtatcagacaagaacgccgaagggaaaccacccctaaatccagacttctactgtctcgtactagtttacttaggtttcactacttaccgtcggtaacggtcccagttcccgtaaagggtttcaaggggttgggtcgggtagggtactcgtaggggactagtactttcacttcactaccatcagcagtcagactatacgtaagttntttcgaacttaacttacgtactaggtacctaaacggttacgggttacccgaaccctgtcctaacgtacgttccggtacggggacggaaacggggtaacttacgggttagaacgtaactaaacgaacgtacggtggcgtcgttcgtaacc

SEQ ID NO: 312011 - DNA, 544 bp, Homo sapiens
  misc_feature: GZ8MTXP01BBE1F.52.9.A09.1.454.CMB.2.raw
  modified_base (228)..(228): a, c, t, g, unknown or other
  misc_feature (228)..(228): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
  modified_base (495)..(495): a, c, t, g, unknown or other
  misc_feature (495)..(495): n is a, c, g, or t
  modified_base (526)..(526): a, c, t, g, unknown or other
  misc_feature (526)..(526): n is a, c, g, or t
tcagcgcagtacgacacgaccggtgctcgatttagcgagacgcgcagggaggatggagactggggctcctgctactctggctccgaggtgccagatgtgacatccagatgacccagtctccatcctccctgtctgcatctgtaggagacagagtcaccatcacttgccgggcaagtcagagcattagcagcttatttaaattggtatcagcagaagcaaggggaaacnccctaaactcctgactctctgctgctatctagtttgctatactgacggtccccatccgaggttcaggtgggtcggtgtatcgtagggacagtatttcaccttcacaccatcaagtcaagtcngacaactgtaacgtnttttacgactaacttactacgtcgtacaacgtacggtacgtaaccctgtctcacgtcgttcgggacggggtacggaacgaggtaggagtataacgaaacgtaacgtgacggctcggacctaacattcgtnttccttctacttccttcccgctaatcgtaanactagacgtaattcgaag

SEQ ID NO: 312012 - DNA, 793 bp, Homo sapiens
  misc_feature: GZ8MTXP01EI53F.52.9.A09.1.454.CMB.2.raw
tcagcgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatcgacccagtctccatccctccctgtctgctatctagtagagacagagtcacatctacgttgccggacaagtcagagctattagcagtacttaatttaaatggtatcgagacagaacgaccgaagggaacacccccttaaatcctagtactctacgtgtactcgacttattcgtttagtttagactattaccccgtaggtaccgttaccccgtagttcccgtaaagggttccgtaaggggttgggtaccggggttacggtacgttacgggtacggggtactaaacggtttactttaccaccttccctacctaacctacgttacccgaggtacccgtacggttacctaccgtaaacccgttaaacccgttagggttaaacgtttttacggttttaacgaaaccccttttaaacccggtttaacttaacccgtttacgggttaaacccgtaaaagggtttaccccgggggtttaaaccccggtaacccctcgggttaccccttaacggtttacccggtttccggggttacccgggggaacggggtaaaccggggtaaccgttaaggggttcgggaaaccgtttaacggaacggttaaaaacccgggtcgtttacggggacggttaacccgttaacggtaacccg

SEQ ID NO: 312013 - DNA, 600 bp, Homo sapiens
  misc_feature: GZ8MTXP01A0SEY.52.9.A09.1.454.CMB.2.raw
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
  modified_base (281)..(281): a, c, t, g, unknown or other
  misc_feature (281)..(281): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
tcagcgcagtacgacacgaccggtgctcgatttagcgagacgcgcagggaggatggagactggggctcctgctactctggctccgaggtgccagatgtgacatccagatgacccagtctccatcctccctgtctgcatctggtaggagacagagtcaccatcacttgccgggcaagtcagagcattagcagtcttaattttaaattggtatcagcagaacgccaaggggaaacncccctaaatcctgatctctgacngctattctagtttcgactattacnggtacggtccccatcccgaggttcaggtcgggacggtggactcggaggactagtactttcgaccctctcaacntacaagcngtctgactaacgtgaattntttacgacctaacttactactcgtaacgaacggtacgggttaaccgacctgtactctaacgttcgtacggggcggggtaagggaccgtaagggtacgaatacggtaaccaaacggtactgggtcggtactcgcctaacgtacttcgtcgttccttcgtaacctttcccgttccccactaacgttccgtaagtaactacgttaccgtaagttcgtaacgg

SEQ ID NO: 312014 - DNA, 648 bp, Homo sapiens
  misc_feature: GZ8MTXP01C4EDT.52.9.A09.1.454.CMB.2.raw
tcagcgcagtacgacacgaccggtgctcgatttagcgagacgcgcaggggaggatggagactggggctcctgctactctggctccgaggtgccagatgtgacatccagatgacccagtctccatcctccctgtctgcatctgtaggagacagagtcaccatcacttgccgggacaagtcagagctattagacagtacttaattttaaaagttggaatcgaagcaaagaaacgccgaaaggggtaaactaccctaaatcctagaatcgtactgactagacagttctagtttacacctaagttacctggaaccgtaccccaagtaccgaaggttcaaggtgggacggttaggaatccgtagggaactaggtaacttttaccacccgtactacaacccggtaaatccgaaagtcgtaacgtcctaagaaacctaacgtaggtaaattctttacgaaccttaaacgttacgtacgtacgtaacgaaacgttacgggttaaccgacctgactacgtacgttacgtacgggacgggggtaacgggaacgtaaggtagaagaacgtaacgaaaggactaggtcgactacactaactattcgtattctactacttcccgttccactaatacgtaataactagttacgtcgcgtaag

SEQ ID NO: 312015 - DNA, 513 bp, Homo sapiens
  misc_feature: GZ8MTXP02GD20M.52.9.A09.1.454.CMB.2.raw
  modified_base (214)..(214): a, c, t, g, unknown or other
  misc_feature (214)..(214): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (324)..(324): a, c, t, g, unknown or other
  misc_feature (324)..(324): n is a, c, g, or t
  modified_base (401)..(401): a, c, t, g, unknown or other
  misc_feature (401)..(401): n is a, c, g, or t
tcagcgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacttgccgggnaagtcagagcattagcagctattaaatgtatcagcagagccaagggaacncccctaaactcngatctctgctgctatctagttgctatactgacgtccatccgaggttcnggtggcggtggatcgtgggacagtacttcactctacaccagtcagcacgtctcgctaaactagaagttacgttttanactaacttactacttcgtacaacgtacgggttaccgaaccctgactctactcgttcggacggacggaccgaaggtgaacgtaagtacgaaacgtacgtggtcgcgtcgaccg

SEQ ID NO: 312016 - DNA, 628 bp, Homo sapiens
  misc_feature: GZ8MTXP02F3IAX.52.9.A09.1.454.CMB.2.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (321)..(321): a, c, t, g, unknown or other
  misc_feature (321)..(321): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
tcagcgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcacatcacttgccgggnaagtcagagcattagcagtacttaatttaaatggtatcagcaagaacgaccgaaaggggaaaccaccccctaaactcctagtactcctctgctgctattctagttnactatacctgacgtccatccgaggttcnggtgggcggtgactcgtaggactagtnttcactctacactatacagcagttcacgacctaaacgtgtaaacgttattttacgaccttaaacttacttaaccgttacggtaaccgtaaaacgggttacggggttaaacccggtaaaccccttggtacccttacgtaacggtttcccgggttaccgggggaacggggtaaaccggggtaaccggaaaacggggttggaaacgtaacgttaaaccgaaaacggtaaccgttggttacggccttacggaaccc

SEQ ID NO: 312017 - DNA, 673 bp, Homo sapiens
  misc_feature: GZ8MTXP02GOF5L.52.9.A09.1.454.CMB.2.raw
  modified_base (393)..(393): a, c, t, g, unknown or other
  misc_feature (393)..(393): n is a, c, g, or t
tcagcgcagtacgacacgaccggtgctcgatttagcgagacgcgcaggggggagtcagtctcagtcaggacacagcatggacatggacgggtccccgctcagctccgtggggctcctgctactctggctccgaggtgccagatgtgacatccagatcgacccagtcctccatccctccctgtctgcatctgaggagacagagtcaccatcacgttcggccgggacaagtcagagctattagcagtcttaatttaaagttggtaatcgagacgaaggaacggaccgaaaggggaaacctacccccgtaaaacttcccgtagaccttctcgtcggtctcgctaagttccttagtttcgaccttataccgtggaccgtcccaagtccgtaggttcngggtcgggcggttggactcggtagggactagtactttcactcacaccagtcacgtactagtctacgactaaccttagtaagttacgttttagaccttaaactttaacctacttacgtaccgaaacggttaacgggtttaacccgaaccgttacgtccttaacgtcggtttaccggttaccggggaaaccggggtaaacgggtaaacccgtaaaacggggtaggtaaacggaaacttaaaccggaaaacgttaccggtaggtcggtaccgtacggtacccg

SEQ ID NO: 312018 - DNA, 480 bp, Homo sapiens
  misc_feature: GZ8MTXP02H6WFY.52.9.A09.1.454.CMB.2.raw
  modified_base (301)..(301): a, c, t, g, unknown or other
  misc_feature (301)..(301): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (338)..(338): a, c, t, g, unknown or other
  misc_feature (338)..(338): n is a, c, g, or t
  modified_base (479)..(479): a, c, t, g, unknown or other
  misc_feature (479)..(479): n is a, c, g, or t
tcagcgcagtacgacacgaccggtgctcgatttagcgagacgcgcagggaggatggagactggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaagccagggaaacgcccctaaatcctgatctctgctgcatctagtttgcatactgagtccatccaggttcagtgcggtgatctggaacngattcactctcacntcagcngtctgacaactgaagtntttgactaattactactgtacaacgaggttacgaacctgctcatcgttcggaggagggtaccaaggtggaagactacgaaacgactggtggctgcctaccgatctgtactcactccttccgcaagtcatactatcgatcgng

SEQ ID NO: 312019 - DNA, 539 bp, Homo sapiens
  misc_feature: GZ8MTXP02GJAF0.52.9.A09.1.454.CMB.2.raw
  modified_base (215)..(215): a, c, t, g, unknown or other
  misc_feature (215)..(215): n is a, c, g, or t
  modified_base (286)..(286): a, c, t, g, unknown or other
  misc_feature (286)..(286): n is a, c, g, or t
  modified_base (333)..(333): a, c, t, g, unknown or other
  misc_feature (333)..(333): n is a, c, g, or t
  modified_base (402)..(402): a, c, t, g, unknown or other
  misc_feature (402)..(402): n is a, c, g, or t
tcagcgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagtctaatttaatgtatcagcagaagccagggaaacacccctaaatcctgatctntgctgcattcttagtttgactataccgtgacgtcccatccaggttcnggtggcgggtgatcgtgggactagtattcactctacactatcagctagtctacgacaaacctgaaattntttacgacttaacttactacgtgtacaaacgtacgggttaaccgaacctgtacctacgacgttcgtcggggacggacggtaccgtaaaggtggaaagaacgtaaacgaaaacggtacgttaggtcggactacgaccc

SEQ ID NO: 312020 - DNA, 538 bp, Homo sapiens
  misc_feature: GZ8MTXP02JLYBP.52.9.A09.1.454.CMB.2.raw
  modified_base (188)..(188): a, c, t, g, unknown or other
  misc_feature (188)..(188): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (335)..(335): a, c, t, g, unknown or other
  misc_feature (335)..(335): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
tcagcgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatgacccagtctccatcctccctgtctgcatctgtagngacagagtcacatcacttgccggacaagtcagagctattagcagtcttaattaaattgtatcagcagaagccaaggaacnccctaaancctagatctngctgctagtcttagttgactataccgtgacggtcccagtccgaggttcngggtcggacggttgggatcggtagggacagtaacttcacttctacacctatcacgcgtacgttcacgacctaaaccgtgtaaacgttatttacgactaacttactactgtactaacgacggttaaccgaacgtncctactnttccgtacggacggaacgggacaacgggtgagaagtaccgaaaagtcgtagtcgcgtcgacc

SEQ ID NO: 312021 - DNA, 636 bp, Homo sapiens
  misc_feature: GZ8MTXP02GN0N4.52.9.A09.1.454.CMB.2.raw
  modified_base (230)..(230): a, c, t, g, unknown or other
  misc_feature (230)..(230): n is a, c, g, or t
  modified_base (271)..(271): a, c, t, g, unknown or other
  misc_feature (271)..(271): n is a, c, g, or t
  modified_base (326)..(326): a, c, t, g, unknown or other
  misc_feature (326)..(326): n is a, c, g, or t
  modified_base (358)..(358): a, c, t, g, unknown or other
  misc_feature (358)..(358): n is a, c, g, or t
tcagcgcagtacgacacgaccggtgctcgatttagcgagacgcgcagggaggatggagactggggctcctgctactctggctccgaggtgccagatgtgacatccagatgacccagtctccatcctccctgtctgcatctgtaggagacagagtcaccatcacttgccgggcaagtcagagcattagcagcttaatttaaattggtatcagcaagaagccaagggaaacncccctaaactcctgactctctgctgcatctagttgcatacngacgtcccatccgaggttcagtggcggtggatcgtgggacagtactttcacctcncacatcagcagtcagaccaaccgtgtaacgtnttttacgactaaacttactactacgtacaaacgtacgggttaccgaaccctgtacctactacgttaccggttaccgggacggggtaacgggaaccgtaaggggttacgggaacgtaacgtaacgaaaacgggttaacgttgggttacgggccttacggacccgtaaccgtaacgtttacccttcggtttccctttacctaacccgtttcccgtttacccccggtaccctaaagtttccctaaggttaaacttacgtaaaccggtacttccggtaccgg

SEQ ID NO: 312022 - DNA, 608 bp, Homo sapiens
  misc_feature: GZ8MTXP02I1N42.52.9.A09.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
  modified_base (329)..(329): a, c, t, g, unknown or other
  misc_feature (329)..(329): n is a, c, g, or t
  modified_base (373)..(373): a, c, t, g, unknown or other
  misc_feature (373)..(373): n is a, c, g, or t
tcagcgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagtctaattaatgtatcagcagaagccaaggaacncccctaaatcctgatctctgctgctattctagtttgctatacctgacgtccatccgaggttcngggtggcgggtgactcgtagggactagtactttcactctcaccntcagcagtctacgactaaaccgtagtaaagttacttttacgaccttaaacgtttaactaccgttagttaaccgtaaacggttaacgggtttaacccgaaaccgttcgtaccttacgtaacgtttccggttaccggggaacgggggtaaacggggtaaaccgtaaagggggttacggaaacgtaacgttaaaccggaaaaacggtacggttacgggtacggtacttacggtaaccc

SEQ ID NO: 312023 - DNA, 629 bp, Homo sapiens
  misc_feature: GZ8MTXP02INZGH.52.9.A09.1.454.CMB.2.raw
  modified_base (327)..(327): a, c, t, g, unknown or other
  misc_feature (327)..(327): n is a, c, g, or t
  modified_base (549)..(549): a, c, t, g, unknown or other
  misc_feature (549)..(549): n is a, c, g, or t
tcagcgcagtacgacacgaccggtgctcgatttagcgagacgcgcagggaggatggagactggggctcctgctactctggctccgaggtgccagatgtgacatccagatgacccagtctccatcctccctgtctgcatctgtaggagacagagtcaccatcacttggccggcaagtcagagcattagcagcttaatttaaatggtatcagcagaagccagggaacaccctaaatcctgatctctgctgctatctagtttgctatacgtgacgtccctatccgaggttcaggtggcggtggattcgagggactagtatttccactccncacctatcagctagtctacgacctaaaccgtgtaaagttacttttagaaacttaaagttacctaacgtacgtaactaaacgtacggggtttaacccgtaacccttgtaccctacgtacttcggttccggggaaccggggaacgggttaaccaagggggtagggtaaacgtaaccgtaacggaaaacgttacgttaaggtcggtacctaggaccctaaacgtntttccggttcttacctacttacgttccccgttaacccgcttaacttccgtagtaacttaacgtacccgtagtaccggtcg

SEQ ID NO: 312024 - DNA, 542 bp, Homo sapiens
  misc_feature: GZ8MTXP02IE6XW.52.9.A09.1.454.CMB.2.raw
  modified_base (218)..(218): a, c, t, g, unknown or other
  misc_feature (218)..(218): n is a, c, g, or t
  modified_base (280)..(280): a, c, t, g, unknown or other
  misc_feature (280)..(280): n is a, c, g, or t
  modified_base (317)..(317): a, c, t, g, unknown or other
  misc_feature (317)..(317): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
  modified_base (415)..(415): a, c, t, g, unknown or other
  misc_feature (415)..(415): n is a, c, g, or t
tcagcgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatgacccagtctccatcctccctgtctgcattctgtaggagacagagtcaccatcacttggccggganaagtcagagctattagcagtcttaattaaatggtatcagcaagaacgaccgaaggggaaacncccctaaactcctagactctctgctgctatctagttnctatacctgacgtcccatcaggttcnggtgnggtgatcgtaggatagtnttcacttcacactatcagtcagttcagactaaactggtaactattttanaaccttaactttactcgtagtacaacggttaacggttaccgaaccctgtactcgtacgtcggttcggaacgggacgaaccgtaaggggtacaaggaactaacgaaacgtacgtggtcgactcgaacc

SEQ ID NO: 312025 - DNA, 542 bp, Homo sapiens
  misc_feature: GZ8MTXP02JIZKZ.52.9.A09.1.454.CMB.2.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (338)..(338): a, c, t, g, unknown or other
  misc_feature (338)..(338): n is a, c, g, or t
tcagcgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatgacccagtctccatcctcctgtctgcatctgtagganacagatcaccatcacttgccggnaagtcagagcatagcagctattaatgtancagcagaacgcaaggaacnccctaaatcngatctcngctgctattctagttnctatacgngacgtccatccaggtcnggtgggcgtgatcgtggacngtattcactctcactatcgacgtcacgtctacgaacctaaccgttaggtaaactttacgttttacgaacctttaactttaactacgttacgtaaccgtaaacggtacgggttaccgaaaccctgtcctactacgtcggtacgggacggaacggacgaacgggtgaaggaactaacgaaaaccgtgtacggtcgtcgtacgaccg

SEQ ID NO: 312026 - DNA, 554 bp, Homo sapiens
  misc_feature: GZ8MTXP02F3D5E.52.9.A09.1.454.CMB.2.raw
  modified_base (232)..(232): a, c, t, g, unknown or other
  misc_feature (232)..(232): n is a, c, g, or t
tcagcgcagtacgacacgaccggtgctcgatttagcgagacgcgcagggaggatggagactggggctcctgctactctggctccgaggtgccagatgtgacatccagatgacccagtctccatcctccctgtctgcatctgtaggagacagagtcaccatcacttgccgggcaagtcagagcattagcagcttaatttaaattggtatcagcaagaacgccgaagggaaacncccctaaactcctgatctctgctgcatctagtttgactatactgacgtcccatccgaggttcaggtggcggtgactcgtagggactagtactttcacctcctcacatcagctgtctcgacctaacctgtaaacgttatttcgactaaacttactatcgtacaacgtacggtaccgaacctgctactagtcgtacgggacggtaacgggacgaagggtacggaatacgtaacgtaaacggtagtggtacggctacgacctactacgttctacgttctactacttccctccgtactaatctagtactacgtacgtactcgtacg

SEQ ID NO: 312027 - DNA, 653 bp, Homo sapiens
  misc_feature: GZ8MTXP02JR2HW.52.9.A09.1.454.CMB.2.raw
  modified_base (374)..(374): a, c, t, g, unknown or other
  misc_feature (374)..(374): n is a, c, g, or t
tcagcgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagactcaccatcacttcggccgggacaagtcagagctattagcagtacttaatttaaagttggtatcagcaaggaacgaccgaaagggaaaccgtacccccttaaaactcccgtagacttcgtctcgtctgctattcgttagtttcgactattaccgtcgtacgtccctatccgtaggttcnggggtggcggtgatgtagggactgtacttcactctaccactatcacgtactacgttccgagaaccgtaaccgtaggtaaatttcgtttacgaacttaaaccgtttaactacgttacggtaaccgtaaaacgggttaacgggggttaaccctaccgtacggtacccttacgtaccggttacggttaccgggggaacgggtaaccgggtaacggtaaacgggttggaaaacgtaacgtaaacgaaaccggtaacgtcgggttaacggcttacggtaacccg

SEQ ID NO: 312028 - DNA, 606 bp, Homo sapiens
  misc_feature: GZ8MTXP02IR15M.52.9.A09.1.454.CMB.2.raw
  modified_base (197)..(197): a, c, t, g, unknown or other
  misc_feature (197)..(197): n is a, c, g, or t
  modified_base (264)..(264): a, c, t, g, unknown or other
  misc_feature (264)..(264): n is a, c, g, or t
  modified_base (365)..(365): a, c, t, g, unknown or other
  misc_feature (365)..(365): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (457)..(457): a, c, t, g, unknown or other
  misc_feature (457)..(457): n is a, c, g, or t
tcagcgcagtacgacacgaccggtgctcgatttagcgagacgcgcagggggagtcagtctcagtcaggacacagcatggacatggacgggtcccccgctcagctcctggggctcctgctactctggctccgaggtgccagatgtgacatccagatcgacccagtcctccatccctccctgtctgcatctggtagganacagacgtcaccatcacgttcggccgggacaagtcagacgacattagcagtacttaattaatggtancagcaagagaccgaagggaaaccacccctaaatccagtactcgtctcgtctagactacttctaaggttcactataccgtgacgtccctatccgtaggttcngggtggtcgtgatcgtggactagttattacnctctacacntcagcagttcagtacctaaagtgtaaagttctttacgaaccttaacttaacncgttacgtacgtaaacggtacgggttaacccgaccgttcgacttacgtaccgttcgggttaccggggacgggtaaacggtaaccgtaaggggtacggaaacgtaacgtaaaacccggtaaagtcggtcggttaccgacgtacggaaccc

SEQ ID NO: 312029 - DNA, 630 bp, Homo sapiens
  misc_feature: GZ8MTXP02IBBZE.52.9.A09.1.454.CMB.2.raw
  modified_base (191)..(191): a, c, t, g, unknown or other
  misc_feature (191)..(191): n is a, c, g, or t
  modified_base (310)..(310): a, c, t, g, unknown or other
  misc_feature (310)..(310): n is a, c, g, or t
  modified_base (595)..(595): a, c, t, g, unknown or other
  misc_feature (595)..(595): n is a, c, g, or t
tcagcgcagtacgacacgaccggtgctcgatttagcgagacgcgcagggggagtcagtctcagtcaggacacagcatggacatgagggtcccccgctcagctcctggggctcctgctactctggctccgaggtgccagatgtgacatccagatgacccagtctccatcctccctgtctgcatctgtagganacagagtcaccatcacgttggccggcaagtcagagcattagcagtcttaatttaaagttggtatcaagccaagaacgaccgaaacggggaaactaccccctaaagtcctagacttcctntgctgctatcgtagtttcgactatacccgtgaccggttcccacgttccgtaaggttctaggggttcgggacggtggtaacttcgggtacggggtactagttacctttcacctttccgaccaacctattacgacgtacgtaacgtcctacgactaaaccgttgtaaacgttacgttttacgacttaacttaactacgttagtaaccgtaaacggttacgggttaaccgaaccttcgtaccttacgtacgttccggtacgggacggtaacggaacgtaggtacgaanaacgtaaacgaacgtacgtagtcggactacgaccg

SEQ ID NO: 312030 - DNA, 771 bp, Homo sapiens
  misc_feature: GZ8MTXP02F408T.52.9.A09.1.454.CMB.2.raw
  modified_base (191)..(191): a, c, t, g, unknown or other
  misc_feature (191)..(191): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
tcagcgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatcgacccagtctccatccctcctgtctgcatctgtagganacagacgtcaccatccacgttcggccggganaacgtcaagngactagttagactagtacttaatttaaattggtactacgagacgaaggaacgaccgaacgggaaacctacccccgtaaactccgtagactccgtgtcgctcgacttattaccgtagtttcgacttacgtaccgttacgaccggttaccctacgtaccgttacggttacgtacgggggttcgggtaccggggtaggtaaccttccggggtaaggggttaccctaaggttttaccctttaccctaaacccggttttccaaccccgtactaaccttacccgacggtactaacggttctaaccggaccttaaaccggttagtaaaccgtttacgtttttaaccaaccttaacgtttaaccctaacgttacggaacccgttaaacgggttaacggggtaaccccgtacctagtaccgtttaacgacgtttacgggggttaccccgggaaggggtaaaccccggtagggtaaaccgggttgaaacgggtaaccgtaaaaacccgtaaagggtccggttaggtaccggtaccttacggtaaacccg

SEQ ID NO: 312031 - DNA, 552 bp, Homo sapiens
  misc_feature: GZ8MTXP01DVIOX.11.28.C06.1.454.CMB.2.raw
tcagcgagagataccacgaccggtgctcgatttagagctcacgtattgggtttgggctgatcaggactcctcagttcaccttctcacaatgaggctccttgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaaatctaccaaggcgacctaaatttataaggtttctaggcgggactcgtggggtcccagaccagattcagcggcagtgggtcagggcgctgatttcacactgagaatcagcgaagggtggaggctagaagagtggtcggggtttattacgtgcagtgcgagggtacaaggtgtcggtccttcgccgttcgcgttagttcgggacgggaggggaacccgaaagggttggaagaagtacgaaacgaacgtggttaggtcgttgaaccc

SEQ ID NO: 312032 - DNA, 517 bp, Homo sapiens
  misc_feature: GZ8MTXP01BN7S9.11.28.C06.1.454.CMB.2.raw
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaaatctccaaggcgcctaatttataaggtttctaggcggactcgtggggtcccagaccagattcagcggcagtgggtcagggcgctgatttcacactgagatcagcgagggtgaggctgaagagtgtcggggtttattacgtgcagtgcgagggtacagtgtgggcttcgctcgcagttcggcggagggaccgaagggttggagaagtacaaacgactgttggcttgaacc

SEQ ID NO: 312033 - DNA, 526 bp, Homo sapiens
  misc_feature: GZ8MTXP01EOYU3.11.28.C06.1.454.CMB.2.raw
  modified_base (300)..(300): a, c, t, g, unknown or other
  misc_feature (300)..(300): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcnctaatttataaggtttcaggcggactcgtggggtcccagaccagattcagcggcagtgggtcagggcgctgatttcacactgagaatcagcgaaggggtggaggctagaagatggtcggggtttatactgcatgcgaggtacagtgtgtccttgctcgcagttcgggacggagggaccgaagggttgggagaagtacgaaaacggtactggttcgggcttggaacc

SEQ ID NO: 312034 - DNA, 541 bp, Homo sapiens
  misc_feature: GZ8MTXP01D8WXQ.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctcatctcctgcaggtcaagtcagagcctgttcacgataatgggaacacctacttgagttggttcagcagaggccaggccaaatctccaaggcgacctaatttataaggtttctaaggcgggactctggggtcccagaccagattcagcggcagtgggtcaggcgctgatttcacactgagaatcagcgaggggtggaggctagaagtagtggttacggggtttattactggacagtgcgaggggttacaggttgtcggtcctttcgctcgcagtttccgggcggagggaccgaagggttggaagaatacgaaacgacgtggttaggcgttgaaccc

SEQ ID NO: 312035 - DNA, 525 bp, Homo sapiens
  misc_feature: GZ8MTXP01AJE1H.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataatgggaacacctacttgagttggttcagcagaggccaggccaatctccaaggcgcctaatttataaggtttctaggcgggactctggggtcccagaccagattcagcggcagtgggtcagggcgctgatttcacactgagaatcagcgaggggtggaggctagaagatggttcggggttattacgtgcagtgcgaggtacagtgtggccttcgctcgcagttcgggcggtagggaccgaagggttggagaagtacgaaacgaacgtggaggcttggaacc

SEQ ID NO: 312036 - DNA, 863 bp, Homo sapiens
  misc_feature: GZ8MTXP01ESSF7.11.28.C06.1.454.CMB.2.raw
  modified_base (279)..(279): a, c, t, g, unknown or other
  misc_feature (279)..(279): n is a, c, g, or t
  modified_base (357)..(357): a, c, t, g, unknown or other
  misc_feature (357)..(357): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgtataatgggaacacctactgagttggttcagcagcngcgagcgctacgtaccgacgacgtacctaacgtttacttaacgttacggttacggacggtacggtccgtaccggggtnccccggacgacgtacgtacgtacgtaacgacggtcggtacgggtacgggtacgggtacgggtacggtacgttacgttacgttacttacgtaacgtaacggtaacggtaaacgtaacgtaacgggtacggggtacgggggtacgggggtaacggggtaacgggtaaacgggttaaacgggttaaacggggtttaacggggggttttaacgggggtttttaacggggttttaaccggtttaacggttaacggtacggtaacgggttaacgggttaaacggggttaaacggggttaacggggttaccggggtttacccggggttcccgggtttcccgggttccccggttacccgggttacccgggttaaccggggttaacccgggggttaacccgggggttaaaccgggggttaaaccgggggttaaacgggggtaaacggggtaacgggtaaaccgggtaaaccggtaaaccgggttaaaccgggttaacgggttaacgggtaaccgg

SEQ ID NO: 312037 - DNA, 541 bp, Homo sapiens
  misc_feature: GZ8MTXP01EP463.11.28.C06.1.454.CMB.2.raw
  modified_base (296)..(296): a, c, t, g, unknown or other
  misc_feature (296)..(296): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgtcacgataatggaacactactgagttggttcagcagaggccaggccaaatctccaaggcncctaaatttataaggtttcaggcgggatctggggtcccagaccagatcagcggcagtgggtcaggcgctgattcacactgagaatanagngagggaggaggngagagagtaggttagggttagttatgngagtgngaggtagtagtgtggtcgtcgtcgtcgtcgttacgtcgggacgggacgggaacggaacgggttagggaggaagtaacgtaaacgaacgtaggttacggtcgttcgtaacg

SEQ ID NO: 312038 - DNA, 526 bp, Homo sapiens
  misc_feature: GZ8MTXP01EWSXY.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctattgagttggttcagcagaggccaggccaaatctcaaggcaccttaaatttataaggtttctaaggcgggactcgtggggtcccagaccagatcagcggcaggtgggtcagggcgctgatttcacatgagaatcagcgagggtggaggctagaagagtggtcgggtttatacttgcatgcgaggtagagtgtggtcgtcgcgtcgcgagtcggcgggacgggacggaaggttggagaagtacgaaacgaacgtagttggcgttgtaacg

SEQ ID NO: 312039 - DNA, 573 bp, Homo sapiens
  misc_feature: GZ8MTXP01CENQ8.11.28.C06.1.454.CMB.2.raw
  modified_base (278)..(278): a, c, t, g, unknown or other
  misc_feature (278)..(278): n is a, c, g, or t
  modified_base (376)..(376): a, c, t, g, unknown or other
  misc_feature (376)..(376): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagnggccaggccaatctccgaaggcgaccttaatttataaggtttcaggcgggactcgtggggtcccagaccagattcaggcggcaggtgggtcagggcgntgactttcacactgagaatcgagcgaggggtggaggctagagtagttggtcggggtttattacgtgcagtgcgtagggtacgtaggtgtcgggtccttcgcgtcggcgttacggttcgggacggggtaaacgggggccgaaaggggttcggaaggaagtaccgaaacggtaacgtggttacggcgttaaggaacccg

SEQ ID NO: 312040 - DNA, 556 bp, Homo sapiens
  misc_feature: GZ8MTXP01AZE8V.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgacctaatttataaggtttctaggcgggactcgtggggtcccagaccagattcgagcggcaggtgggtcagggcgctgtatttcacactgaagaatcagcgaggggtggaggctggaaagtagtgggttacggggtttattacgtggtcagttggcgagggtacaggtgtcggtccttcgctcggcttaggttcgggcgggaacggggtaccaaggggttggagaatacgaaacggaacgtggttaggcttggaacc

SEQ ID NO: 312041 - DNA, 548 bp, Homo sapiens
  misc_feature: GZ8MTXP01DQ1FM.11.28.C06.1.454.CMB.2.raw
  modified_base (379)..(379): a, c, t, g, unknown or other
  misc_feature (379)..(379): n is a, c, g, or t
  modified_base (451)..(451): a, c, t, g, unknown or other
  misc_feature (451)..(451): n is a, c, g, or t
tcagcgagagataccacgaccggtgctcgatttagagctcacgtattgggtttggggctgatcaggactcctcagttcaccttctcacaatgaggctccctgctcagctccgtggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctattgagttggttcagcagaggccaggccaaatctaccaaggcgtaccttaaatttagtaaggtttctaggcgggactcgtggggtcccagaccagattcgagcggacaggtggtcagggcnctgtatttcacactgaagaatcaagcgaggggtggaggcgtagaagagtggttacggggtttaatacgtganagtgcgagggtacagtgtggtccttcgctcgcttaggttcgggacggaagggacgaagggttggaaggaatacgaaacgtatggttcggcttgaacc

SEQ ID NO: 312042 - DNA, 515 bp, Homo sapiens
  misc_feature: GZ8MTXP01ATKTD.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaaatctccaaggcgcctaaatttataaggtttctaggcgggactctgggggtcccagacccagattcagcggcagtggtcagggcgctgatttcacactgagaatcagcagggtggagctgaagatgtcggggttatactgcatgcagggtacagtgtggccttcgctcgcagttcggcggagggaccagggttggagaatacgaaacgaactggttcgcgttaagcc

SEQ ID NO: 312043 - DNA, 538 bp, Homo sapiens
  misc_feature: GZ8MTXP01DZPKL.11.28.C06.1.454.CMB.2.raw
  modified_base (414)..(414): a, c, t, g, unknown or other
  misc_feature (414)..(414): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctcctgcaggtcaagtcagagcctcgttcacgataatggaacactactgagttggttcagcagaggccaggccaaatctccaaggcgaccttaaatttataaggtttctaggcgggtactcgtggggtcccagaccagattcgagcggacaggtgggtcagggcgctgatttcacactgagaatcagcgagggtgagctgaagntggtcgggtttatacgtgcagtgcgagggtacaggttgtcgggtccttcgctcggcaggttcgggacgggtagggaccaaggggttggaagaatacgaaacgagtggttacggtcgttggaacc

SEQ ID NO: 312044 - DNA, 568 bp, Homo sapiens
  misc_feature: GZ8MTXP01EOP4T.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataatgggaacacctacttgagttggttcagcagaggccaggccaaatctaccaaggcgaccttaaatttagtaaggtttctaggcgggtactcgtggggtcccagaccagatcgagcggcagtgggtcagggcgctgatttcacactgagaatcagcgaggggtggagctagagagtggtacggggtttatacgtgctagtggcgtaggggttacaggttggtcggtcctttcgcgtcgcgttagttcggggcgggaacgggtaaccgaaggggttggaaggtaagtaccgaaaacggtaacgtgggttacgggtcttggaaccc

SEQ ID NO: 312045 - DNA, 585 bp, Homo sapiens
  misc_feature: GZ8MTXP01EAFW7.11.28.C06.1.454.CMB.2.raw
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (316)..(316): a, c, t, g, unknown or other
  misc_feature (316)..(316): n is a, c, g, or t
  modified_base (350)..(350): a, c, t, g, unknown or other
  misc_feature (350)..(350): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacactattgagttgttcagcagagcagcaatcncaagcnctaatttatagttcaggcggactcgngggtccagacagatcgagcgcagtgggtcaggcnctgattcacactgagatcgagcgaggggtggagcgtagaaagagttgggttccggggtttaattacgtggactagtacggcgtaaggggtactaaggttcgggtcgtcccgttcggccgttcggcgttaagggttccggggaccggggtaaaggggaacccgttaaagggggttgggaaaacgtaacgttaaccggaaaaaccggtaacggttggcgggtaacgttcggaacccc

SEQ ID NO: 312046 - DNA, 531 bp, Homo sapiens
  misc_feature: GZ8MTXP01CGT0Z.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgacctaaatttataaggtttctaaggcgggactcgtggggtcccagacccagattcagcgcagtgggcagggcgctgatttcgacactgagaatcagcagggtggaggctgaagagtgtcggggtttattacgtgcatgcaggggtacaggtgtggcttcgctcgcttagttcgggcgggaagggacccgaagggttggagaatacgaaacgaatggttcgcgttggaacc

SEQ ID NO: 312047 - DNA, 529 bp, Homo sapiens
  misc_feature: GZ8MTXP01DRDTG.11.28.C06.1.454.CMB.2.raw
  modified_base (372)..(372): a, c, t, g, unknown or other
  misc_feature (372)..(372): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgacctaatttataaggtttctaggcgggactcgtggggtcccagaccagattcagcggcagtgggtcagggcnctgatttcacactgagaatcagcgaggggtggaggctgaagattggtcggggttttattacgtgcagtgcgagggtacaggttgtggccttcgctcgcagttcgggcggagggaccaagggttggagaatacgaacgaacgtggttacggcttggcc

SEQ ID NO: 312048 - DNA, 563 bp, Homo sapiens
  misc_feature: GZ8MTXP01BL05A.11.28.C06.1.454.CMB.2.raw
  modified_base (472)..(472): a, c, t, g, unknown or other
  misc_feature (472)..(472): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagaacctcgttcacgataatggaacacctacttgagtgttcagcagaggccaggccaatctaccgaaggcgtaccttaaatttataaggttttctagggcggtactcgtgggggtcccagacagattcgagcggcaaggtgggtcagggcgctgtatttcacactgagaatcgagcgaggggtggaggctaggaagtagttgggttacggggtttattacggtgcgtagtggacgtagggtacnggtgtcggtccttcgcgtcgctagttcgggcgggacgggaccgagggttaggagttacgtaacgaaacgtaacgtggtaggctgccgaacc

SEQ ID NO: 312049 - DNA, 580 bp, Homo sapiens
  misc_feature: GZ8MTXP01CSHU2.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtgggaacacctattgagttggttcagcagaggccaggccaatctacaaggctactaaatttataaggtttctaggcggactcgtcggggtccagaccagtattcgagcggcaggtgggtcagggcgctgatttcacactgagaatcgagcgagggtggagcgtaggaagagttgggttacggggtttattacgtgtcagtgcgagggtacgaggtgtcggtccttcgcgtaacgcgttacggttcggggcgggtaaacggggaccgaaaggggttggaaacggtaacgttaaaccgaaaacggtaacgttggttcggtccgttggtaacccg

SEQ ID NO: 312050 - DNA, 575 bp, Homo sapiens
  misc_feature: GZ8MTXP01B88IT.11.28.C06.1.454.CMB.2.raw
  modified_base (387)..(387): a, c, t, g, unknown or other
  misc_feature (387)..(387): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaaacacctactgagttggttcagcagagccagcaatctacaagcactaatttataaggtttcaggcggactcgtgggtcccagaccagatcagcgacaggtggcagggcactgactttcgactacgtagaagaacncgaggcggaggggtaggagacgtaggaagtagttgggtttacgggtttatacgtgacgtagtcggacggtaggtacgtaggtcgttccggtccgtcgtcgtcggcgttacgggtcgggacgggtaacgggaacgttaaggggttggaacgtaacgtaacgaaacgtacgtggttacgtcgttcgaacc

SEQ ID NO: 312051 - DNA, 556 bp, Homo sapiens
  misc_feature: GZ8MTXP01DXKQE.11.28.C06.1.454.CMB.2.raw
  modified_base (371)..(371): a, c, t, g, unknown or other
  misc_feature (371)..(371): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctcatctctgcaggtcaagtcagagcctgttacacgataatggaacactacttgagttggttcagcagaggccaggccaaatctaccaaggcgtaccttaatttagtaaggtttctaaggcggtactcgtggggtcccagaccagatcagcggcagtgggcagggcnctgatttcacactgagaatcagcgagggtggagcgtagaagataggttcggggtttattacgtggcagtgcgagggtacgtagtggtggtccttcggcgtcgcgttaggttcgggacgggacgggaaccgaagggttgggaagaagtaaccgaaacggtaacgtggttacgggtcttaagtcccg

SEQ ID NO: 312052 - DNA, 556 bp, Homo sapiens
  misc_feature: GZ8MTXP01A1PBQ.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaaatctccaaggcgtaccttaaatttagtaaggtttctagggcgggtactcgtggggtcccagaccagattcgagcggcaggtgggtcagggcgctgtatttcacactgagaatcagcgaaggggtggaggctaggaagtagttgggttacggggtttattacgtgactagtgcgagggtacaggttgtcggtccttcgctcgcgttagttcgggcgggtagggaccgaagggttcggagaatacgaaacgacgtgcggtcgttgaacc

SEQ ID NO: 312053 - DNA, 524 bp, Homo sapiens
  misc_feature: GZ8MTXP01CGC2L.11.28.C06.1.454.CMB.2.raw
  modified_base (445)..(445): a, c, t, g, unknown or other
  misc_feature (445)..(445): n is a, c, g, or t
  modified_base (462)..(463): a, c, t, g, unknown or other
  misc_feature (462)..(463): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctcctgcaggtcaagtcagagcctgttcaacgataatgggaacacctacttgagttggttcagcagagccaggcaaatctccaagcgactaatttataaggtttctaggcgggactcgtggggtcccagaccagattcagcggacagtgggcaggcgctgatttcacactgaagaatcagcgaagggtgggaagctagaaagatggtacggggtttattactgcatgcgaggtanagtgtggcttcgctcgnngttcggcggaagggccaaagggttggaagaataacgaaacgaacgttggaggccttgaacc

SEQ ID NO: 312054 - DNA, 550 bp, Homo sapiens
  misc_feature: GZ8MTXP01A9MHL.11.28.C06.1.454.CMB.2.raw
  modified_base (273)..(273): a, c, t, g, unknown or other
  misc_feature (273)..(273): n is a, c, g, or t
tcagcgagagataccacgaccggtgctcgatttagagctcacgtattgggtttgggctgatcaggactcctcagttcaccttctcacaatgaggctccctgctcagctcctgggctgctaatgctctgggtcccagtgtccagtgggatgttgtgttgactcagtctccactcctccctgcccgtcacccttggacagccgcctccatctcctgcaggtcaagtcagagcctcgttcacgataatggaacacctactgagttggttcagcagngccaggccaatctaccaaggccgaccttaatttagtaaggtttctaaggcggacttcgtggggtcccagaccaggattcgagcggacagtgggtcagggcgctgattcgacactgagaatcgagcgaggggtggaggctaggaagagtgggttacgggtttattacgtgctagtgcgaggggttacaggttgtggtcccgttcggcttcgcaggttcgggacgggagggaaccagggttggagaacgtacgaaacgtacgtggcggtcttggaaccc

SEQ ID NO: 312055 - DNA, 712 bp, Homo sapiens
  misc_feature: GZ8MTXP01EHJYY.11.28.C06.1.454.CMB.2.raw
tcagcgagagataccacgaccggtgctcgatttagagctcacgtattgggtttggggctgatcaggactcctcagttcaccttctcacaatgaggcctccctgctcagctccgtggggctgctaatgctctgggtcccagtgtccaggtggggatgttgtgttgactcagtctccactcctccctgcccgtcacccttggacagcccgcctccatcctcctgcaggtcaagtcagacgtcccttcgttacaacgaataaagtcgggaaacctaccgtacttggagtttggttcaaggccaaggacggcccaaggacccaaagtcctaaccgaagggtcctaacctttaaaattttacgtaaaggttttcgaaggggccgggtacttcggtcggggtacccaagtaccaggtatcgaggcggactagggtcggggtacaaggggtccctagttagtactttacaaccgtacgttaggaaagtaaacgtcgaaggcggtaagggggtaggaaggtacgtaggaaagtcgttagggtttacgggtttaattcgtggacctagtacggagtacggggtataggttcgtcggtcccgtttcgcgtcccggagttcgggttaccgggggacggggaaacggggtaaccgttaaaggggttgggaacgtaaacgttaaccgaaaaccggtacggttggttacggccttaacggaacccc

SEQ ID NO: 312056 - DNA, 585 bp, Homo sapiens
  misc_feature: GZ8MTXP01BA0GM.11.28.C06.1.454.CMB.2.raw
  modified_base (201)..(201): a, c, t, g, unknown or other
  misc_feature (201)..(201): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccttggacngccgcctccatctcctgcaggtcaagtcagacgcctcgttcacgataatgggaacacctacttgagttggttcagcagaggccaggccaatcctaccaaggccgtaccttaaatttagtaaggtttctagggcgggtactcgtcggggtcccagacccagattcgaggtcggcaggtgggtcaggcgctgatttcacactgagaatcaggcgaggggtggaggcgtagaaggtagttagggttacgggggtttattacgtggactaagtgacgtaagggtactagggtggttcggtccttcgcgtcgcgttaggttcggggacggtagggaccgaagggttggaagtaataacgaaacgtaacgtggttacggcgttgaacccg

SEQ ID NO: 312057 - DNA, 555 bp, Homo sapiens
  misc_feature: GZ8MTXP01BFSFI.11.28.C06.1.454.CMB.2.raw
  modified_base (378)..(378): a, c, t, g, unknown or other
  misc_feature (378)..(378): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacactacttgagttggttcagcagaggccaggccaaatctaccaaggcgtaccttaaatttataaggtttctaggcgggactcgtggggtcccagaccaggattcgagcggcaggtgggtcagggcnctgatttcacactgagaatcgagcgaggggtggaggcgtagaagtagttaggttacggggtttattacgtggactagtgcgtagggtacaggtgtcggtccttcgcgtcgcgttacgttcgggacggagggaccgaagggttggagaatacgaaacgacgtggttacgcgttgaacc

SEQ ID NO: 312058 - DNA, 541 bp, Homo sapiens
  misc_feature: GZ8MTXP01ELTTD.11.28.C06.1.454.CMB.2.raw
  modified_base (373)..(373): a, c, t, g, unknown or other
  misc_feature (373)..(373): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgccccgtcacccttggacagccggcctccatctcctgcaggtcaagtcagagcctgttcaacgataagtggaacacctattgagttggttcagcagaggccagccaatctacaaggcactaatttagtaaggtttcaggcgggactcgtggggtcccagaccagattcagcggacaggtggggtcagggcnctgtatttcacactgaagaatcgaagcgaaggggtggaggcgtagaagagtggttacggggtttattacgtgcagtgcgagggtacaggtgtggtcctttcgctcgcgttagttcgggacggagggaaccagggttgaagtaatacgaaacgtagtgagcgttgaacc

SEQ ID NO: 312059 - DNA, 540 bp, Homo sapiens
  misc_feature: GZ8MTXP01DT9JE.11.28.C06.1.454.CMB.2.raw
  modified_base (415)..(415): a, c, t, g, unknown or other
  misc_feature (415)..(415): n is a, c, g, or t
  modified_base (471)..(471): a, c, t, g, unknown or other
  misc_feature (471)..(471): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaaatctccaaggcgtacctaaatttataaggtttctaggcgggactcgtggggtcccagaccagattcagcggcagtgggtcagggcgctgatttcacactgagatcagcgagggtggaggctgaagngtagttcggggtttattacgtgcagtgcgaggtacagtgtcgtcttcgcttcgcgngttcgggcgggtagggaccgaagggttggaagtaagtaacgaaacgtaacgtggttggtcgttggaacc

SEQ ID NO: 312060 - DNA, 546 bp, Homo sapiens
  misc_feature: GZ8MTXP01DOG3M.11.28.C06.1.454.CMB.2.raw
  modified_base (372)..(372): a, c, t, g, unknown or other
  misc_feature (372)..(372): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgaatcagtctccactctccctgcccgtcacccttggacagccggcctccatctcctgcaggtcaagtcagagcctcgttcacgataatgggaacacctacttgagttggttcagcagaggccaggccaaatctccaaggcgacctaatttataaggtttctaggcgggactcgtggggtccagaccagattcagcggcagtgggtcagggcncgtgatttcacactgagaatcagcgaggggtggaggctagaaagagttaggttcggggtttaattacgtgcagtgcgagggtacaggtgtggtccttcgctcgcagtttcgggcggagggtaaccgaagggttgggaagaattacgaaacgaacgtggttaggtcgttggaacc

SEQ ID NO: 312061 - DNA, 556 bp, Homo sapiens
  misc_feature: GZ8MTXP01B6Z3U.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataatggaacactacttgagttggttcagcagagccagcaatctcaaggcgactaatttataggtttctaggcggactcgtggggtcccagaccagattcagcggacagtgggtcagggcgctgatttcacactgagaatcgagcgaaggggtggaggcgtagaaagtagttagggttacggggttttaattacgtggcagtgcgtagggtacaggtgtggtccttcgcttcggcttacggttcgggcgggtaacggggaccgaaggggttcggagtaagtacgaaaacgtacgtggttacggcgttggaaccc

SEQ ID NO: 312062 - DNA, 593 bp, Homo sapiens
  misc_feature: GZ8MTXP01CB8PM.11.28.C06.1.454.CMB.2.raw
  modified_base (435)..(435): a, c, t, g, unknown or other
  misc_feature (435)..(435): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcaacgataaagtgggaactacctacttgagttggttcagcaggacggccaggccaaatcctaccgaaggccgtaccttaaatttagttaaaggttttcgtaggcgggtacttcgtgggggtcccagacccagtattcgagcggacaggtgggcagggcgctgattcactactgaagatcagcgagggtggaaggtntaggaagtagtgggttacggggtttaattacgtgcagtgcgagggtacgagttggtcggtccttcggcctcggtcgttaggttcgggacgggtaacggggaccgaaggggttggaagtaagtaaccgaaacggtacgtggttcggtcgttcggtaacc

SEQ ID NO: 312063 - DNA, 508 bp, Homo sapiens
  misc_feature: GZ8MTXP01EVPQE.11.28.C06.1.454.CMB.2.raw
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (460)..(460): a, c, t, g, unknown or other
  misc_feature (460)..(460): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctcatctcctgcaggtcaagtcagagcctcgttcacgataatgggaacactacttgagttggttcagcagagccagccaatcncagcnctaattatagttnaggcggatcgtgggtccagaccagatcgagcggcagtggtcagggcgctgatttcgacactgagaatcagcgagggtggaggcgtagaagagtggttacggggtttattacgtgacagtgcgagggtacagtgtggcttcgctcgcttagtcggnggaggacgaggttggagaagtacgaaacgactggttacgcgttgaacc

SEQ ID NO: 312064 - DNA, 588 bp, Homo sapiens
  misc_feature: GZ8MTXP01CB23J.11.28.C06.1.454.CMB.2.raw
  modified_base (295)..(295): a, c, t, g, unknown or other
  misc_feature (295)..(295): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatctcctgcaggtcaagtcagagcccttgttacacgataagtgggaacacctattgagttggttcagcaggaggccaggccaaatcnccaaaggccgtaccttaatttagtaaggtttctaggcggactcgtcggggtcccagaccagattcgaggcggcgaggtgggtcagggctctgatttcacactagagatcgaggcgaggggtggaaggcgtaggaagtagttggttacggggtttattacgtgtacagtgcgtaggggtactaggttgtcgtccgttcgcgttcgcgttggttccgggcgggtaaggggaccgaaagggttgggaagtaacgtaaccgaaaacggtacgttgggttacggtcgttcggaacccg

SEQ ID NO: 312065 - DNA, 560 bp, Homo sapiens
  misc_feature: GZ8MTXP01B354V.11.28.C06.1.454.CMB.2.raw
  modified_base (383)..(383): a, c, t, g, unknown or other
  misc_feature (383)..(383): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctcctgcaggtcaagtcagacgccttcgttcacgaataagtgggaacacctacttgagttggttcagcaggacggccaggccaaatctaccaaggcctaccttaatttagtaaggtttcaggcgggactcgtggggtcccagaccagatcgagcggacaggtgggtcagggcncgtgtattcacactgagaatcgagcgaaggggtggaggcgtagaagagttggttcggggtttattacgtgctagtgcgagggtacagtgtcggcttcgctcgcgttagttcgggacgggacgggaccgagggttgagtaagtaacgaaacggaacgtggttacggtcgttcggaacc

SEQ ID NO: 312066 - DNA, 516 bp, Homo sapiens
  misc_feature: GZ8MTXP01DX7SE.11.28.C06.1.454.CMB.2.raw
  modified_base (411)..(411): a, c, t, g, unknown or other
  misc_feature (411)..(411): n is a, c, g, or t
  modified_base (504)..(504): a, c, t, g, unknown or other
  misc_feature (504)..(504): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaaatctccaaggcgcctaatttataaggtttctaggcgggactcgtggggtcccagaccagattcagcggcagtgggtcagggcgctgatttcacactgagaatcagcagggtgaggctgaagntgtcggggtttattactgcatgcagggtacagtgtgcttcgctcgcagttcggcggtagggccgaaggttggaagaatacgaaacgactaggnggtcttggaacc

SEQ ID NO: 312067 - DNA, 589 bp, Homo sapiens
  misc_feature: GZ8MTXP01BC1NB.11.28.C06.1.454.CMB.2.raw
  modified_base (384)..(384): a, c, t, g, unknown or other
  misc_feature (384)..(384): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgaatcagtctccactctccctgcccgtcacccttggacagccggcctccatctcctgcaggtcaagtcagagcctgttcacgataatggaacactacttgagttggttcagcagaggccaggccaaatctaccgaaggccgaccttaaatttagtaaggtttctagggcgggactcgtcggggtcccagaccaggtattcgaggtcggcaggtgggtcagggcnctgactttcacacgtgagaatcgagcgaaggggtggaggcgtaggaaagtagttgggttacggggtttattacgtggctaagtggcgaggggtacaggttcggtcggtccctttcggcgtcgcgttaggttcggggcgggaagggaaccgaaggggttgggaagtaacgtacgaaaacggacgttgggacgggtcttcggaaccc

SEQ ID NO: 312068 - DNA, 546 bp, Homo sapiens
  misc_feature: GZ8MTXP01DJMQH.11.28.C06.1.454.CMB.2.raw
  modified_base (408)..(408): a, c, t, g, unknown or other
  misc_feature (408)..(408): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctctgcaggtcaagtcagagcctcgttcacgataatgggaacactacttgagttggttcagcagagccaggccaatctcaagcgctaatttataaggtttcaggcgggactcgtggggtcccagaccagattcgagcggcagtgggtcagggcgctgatttcacactgagaatcagcgaggggtggaggctagaagngttggttcggggtttaattacgtgactagtgcgagggtacgaggttggtcgggtccttcgcgtcgcttagttcgggacgggtagggaccgaagggttggaagtaatacgaaacgtaacgtggttcggtcgttgaaccg

SEQ ID NO: 312069 - DNA, 656 bp, Homo sapiens
  misc_feature: GZ8MTXP01BDSJ5.11.28.C06.1.454.CMB.2.raw
  modified_base (561)..(561): a, c, t, g, unknown or other
  misc_feature (561)..(561): n is a, c, g, or t
tcagcgagagataccacgaccggtgctcgatttagagctcacgtattgggtttggggctgatcaggactcctcagttcaccttctcacaatgaggctccctgctcagctccgtggggctgctaatgctctgggtcccagtgtcaggtggggatgttgtgttgactcagtctccactcctccctcgcccgtcacccttggacagccgcctcatctctgcaggtacaagtcagacgtccttcgttacaacgtaataagtcgggaacctacctattgaggttgttacagcagacgaccagaccaaatcgtaccgaagtctacttaaatttagtaaggtttcgagggcgggtacttcggtacgggtacccaagacaggtatcgaggcggtaacgagggttcgggcacgggtcgtatgtaactttcaacgtataggaaagtaactcggaaggcgggtaaagggggtggaacggtagtaagggaaagttggttaggggttttacgggtttaataacgtgactagtaggcggtagggtactagggttcgtcggtccttcgcgtcccgngttacgggttccgggacggggtaaacggaaccgttaagggggttgaaaacgttaacgaaacgaaaaccgtcggtggttacggcttaacgaacccg

SEQ ID NO: 312070 - DNA, 558 bp, Homo sapiens
  misc_feature: GZ8MTXP01AKV1I.11.28.C06.1.454.CMB.2.raw
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (368)..(368): a, c, t, g, unknown or other
  misc_feature (368)..(368): n is a, c, g, or t
  modified_base (429)..(429): a, c, t, g, unknown or other
  misc_feature (429)..(429): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttgttcagcagagcagccaatcncaagcnctaattatagtttcaggcggatcgtggggtccagaccagatcaggcgacagtgggtcagggcgctgattcaacnctagagaatcgagcgagggtggaggtctaggaagtgtcggttacggggtttattacgtggntagtgacgtaggtacgtaggttcggtcgtccgtcgtctcggtcgttacgggttccgggacgggtaacgggtaacggttaagggttcggaagtaacgtacgtaagtacggtaacgttggtcggcgtaacg

SEQ ID NO: 312071 - DNA, 529 bp, Homo sapiens
  misc_feature: GZ8MTXP01ER2KZ.11.28.C06.1.454.CMB.2.raw
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (517)..(517): a, c, t, g, unknown or other
  misc_feature (517)..(517): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaaatttataaggtttctaggcgggactcgtgggggtcccagacccagattcgagcggcagtgggtcagggcgctgatttcacactgagaatcgagcgaaggggtggaaggctagaagattaggttcgggggtttaattacgtggcagtgcgagggtacaggtgtggcttcgntcgnagttcggcggagggaccagggttgagaananaaacgangagcgttgaacc

SEQ ID NO: 312072 - DNA, 648 bp, Homo sapiens
  misc_feature: GZ8MTXP01EL5KM.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagcccggcctccatctcctgcaggtcaagtcaagacgtcccttcgttacaacgtaataagtgggaaaccaccttacttgagttggttcagcaggagccaggccaatcacaggctacttaatttagtaaggtttcaggcggactcgtcggggtacccagaccagtattcgaggcggcaggtcggggtcacggggctcgttagtacgtttccaactacgtagaagtaaatcgaaggcggtaagggggtaggagggtacgtaaggaaaggtagttacggggtttacgggggttttaattacgtggtaccagttcggccgtagggtaactagggttcgtcgggtcctttcggctaaccggtcgttacgggttccggggacggggtaaccgggtaacgaagggggttggaagtaacgtaacgaaacggtacggtggcggtaacgttcggaacccg

SEQ ID NO: 312073 - DNA, 562 bp, Homo sapiens
  misc_feature: GZ8MTXP01AIBDH.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcaacgataagtgggaacacctacttgagttggttcagcagaggccaggccaatctaccaaggcgtacttaatttagtaaggtttctaggcggtactcgtggggtcccagaccagattcgaggcggacaggtgggcagggcgtctgtatttcacacgtgaagaatcgagcgaggggtggaggctaggaaagtagttgggtttacggggtttaattacgtgactagtggcgtagggtacgtaggtgtcggtccttcgctcgcgttagtcgggacggaacgggaccgaagggttgagaactacgaacgtagtggttagcttgaacc

SEQ ID NO: 312074 - DNA, 525 bp, Homo sapiens
  misc_feature: GZ8MTXP01EMK0X.11.28.C06.1.454.CMB.2.raw
  modified_base (357)..(357): a, c, t, g, unknown or other
  misc_feature (357)..(357): n is a, c, g, or t
  modified_base (399)..(399): a, c, t, g, unknown or other
  misc_feature (399)..(399): n is a, c, g, or t
  modified_base (441)..(441): a, c, t, g, unknown or other
  misc_feature (441)..(441): n is a, c, g, or t
  modified_base (510)..(510): a, c, t, g, unknown or other
  misc_feature (510)..(510): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacagccggcctcatctcctgcaggtcaagtcagagcctgtcacgataagtggaacactacttgagttgttcagcagagcagcaatcacagcactaattataaggttctaggcggactcgtggggtcccagaccagatcgagcggacaggtgggcagggcnctggtatttcaacactgaagaatcgagcgaaggggtggaggntagaagagtgttacggggtttatacgtgcagtgcgagggtanaggtgtgggtccttcgctcgtcgaggttcgggcgggaagggacgaagggttgaagaagtacaaagtacnggttagcgttgaacc

SEQ ID NO: 312075 - DNA, 525 bp, Homo sapiens
  misc_feature: GZ8MTXP01EDPGT.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataatgggaacacctacttgagttggttcagcagaggccaggccaaatctaccaaggcgacctaaatttataaggtttcaggcgggactcgtggggtcccagaccagattcagcgacagtgggcagggcgctgatttcacactgagaatcagcgaggggtgaggctagaagagtggtcggggtttatacgtgacagtgcgagggtacagtgtggtccttcgctcgcagttcgggcggaagggaccaagggttgagaatacgaaacgatggttaggcttgaacc

SEQ ID NO: 312076 - DNA, 560 bp, Homo sapiens
  misc_feature: GZ8MTXP01EEMIS.11.28.C06.1.454.CMB.2.raw
  modified_base (372)..(372): a, c, t, g, unknown or other
  misc_feature (372)..(372): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctcatctcctgcaggtcaagtcagagcctcgttcacgataagtggaacactacttgagttggttcagcagaggccaggccaaatctaccaaggcgacttaaatttataaggtttctaggcggactcgtggggtcccagaccagattcagcggcaggtgggtcagggcnctgatttcacactgagaatcagcgaggggtggaggctagaagagttggttacggggtttattacgtgacgtagtgacgtagggtacaggttggtcggtccttcgctcgcgttaggttccgggacgggacgggaaccgaagggttggaagaagtacgaaacggtaacgtggttaggtccgttcggaacc

SEQ ID NO: 312077 - DNA, 632 bp, Homo sapiens
  misc_feature: GZ8MTXP01A7EWX.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcaacgataagtgggaacacctacttgagttggttcagcagaggccaggccaatctaccaaggcgtaccttaatttagtaaggtttctaggcggtactcgtcggggtccagaccagtatcgagcggacaggtgggtcacgggtccctgtactttcactactagaagtaactcgaggcgaagggggttacgggagggtacgtagggaaagtagttgggttacggggtttaattacggtggtacgtaagttcggacgtaaggggttacgtaggttcggtcggtcccgtttcggccgttcggccgtaaggtttccggggacgggaacgggtaccgaaaggggttcggaagttacgtaacgaaaacggtaacgtgggtacggcctaaggccctaaccg

SEQ ID NO: 312078 - DNA, 623 bp, Homo sapiens
  misc_feature: GZ8MTXP01ACKY6.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgctcgtcaccctggacagccgcctccatctcctgcaggtcaagtcagacgcctcgttcacgataagtcgggaacacctactgagttggttcagcagaggccaggccaatcctacgaaggcgtaccttaatttagtaaggtttcgagggcggtactcgtggggtcccagacagacttcgaggtcggacgtaaggtgggtaccgagggtcgtcgttaggtacttttaccactacgtaggaagtaaagtccgaaggacggagggggttagggagggacgttaggaaaggtagttgggtttacggggggtttattaacgtgactagtggacgagggtacagtggtcgtccgttcgctcggttcgtaggttccgggacgggtaacgggaccgttaagggttaggaagtaacgtaacggaaaacggtacgttcggtcgggctaaccgg

SEQ ID NO: 312079 - DNA, 579 bp, Homo sapiens
  misc_feature: GZ8MTXP01EUHFZ.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtgggaacacctactgagttggttcagcagagccaggccaatctcaaggcactaattataggtttcaggcgggactcgtcggggtcccagaccagtatcgagcggacaggtgggtcagggccgctgtatttcacactgagaatcgagcgaggggtggaggctaggaaagtagttagggttacggggttttaattacgtgactagtgacgtagggtactaggtcggtcggtccttcgcgtcggcgttaggttcgggacgggtacggggaaccgttaaggggttcggaagtaagtaaccgaaaacggtacgtggttacggtcgttcggaacccg

SEQ ID NO: 312080 - DNA, 560 bp, Homo sapiens
  misc_feature: GZ8MTXP01DE823.11.28.C06.1.454.CMB.2.raw
  modified_base (379)..(379): a, c, t, g, unknown or other
  misc_feature (379)..(379): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagcccggcctccatctcctgcaggtcaagtcagagcctcgttacacgataaatgggaacacctacttgagttggttcagcagaggccaggccaaatctccaaggcgacctaaatttataaggtttctaggcgggactcgtggggtccagtaccagattcagcggacagtgggtcagggcgntgatttcacactgagaatcagcgagggtggaggctaggaagagttggttcggggtttattacgtgacagtgcgtagggtacaggtgtggtccttcgcgtcgcagttccgggcgggagggaccgaaagggttgggaagtaacgtaacgaaaaccggaagtgggttaggtccgttggaacccg

SEQ ID NO: 312081 - DNA, 580 bp, Homo sapiens
  misc_feature: GZ8MTXP01AVJMK.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctatgggtcccagtgtccaggtggggatgttgtgttgactcagtctccactctccctgcccgtcacccttggacagccggcctccatctcctgcaggtcaagtcagagtcctcgttcaacgataagtgggaacacctacttgagttggttcagcaggaggccaggccaatctaccaaggctaccttaatttataaggtttcaggcggactcgtggggtcccagacccagattcgagcggacaggtgggtcagggcgctgtactttcactactagagaactcgagcgaggggtggaggtctaggaagtagttgggttacggggtttattacgtgctagtgcgagggtactaggtgtcggtccttcgcgtcgcttaggttcggggacggtaacgggaccgaaggggttcggaagtaacgtaacgaaaacggacgtgggttacggtcgttcgaacccg

SEQ ID NO: 312082 - DNA, 552 bp, Homo sapiens
  misc_feature: GZ8MTXP01BS5IS.11.28.C06.1.454.CMB.2.raw
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagngccaggccaatcncaaggcactaattataggtttcaggcggactcgtggggtccagaccagtattcgaggcggacagggtggtcagggcgctgatttcacactgaagaatcgaagcgaggggtggaggctaggaaagtgttggttcggggtttatacgtgacagtgcgtagggtacaggtgtcggtccttcgctcggcttaggttccgggcgggaacgggaccgttaaggggttggacgtaataacgaaacgacgtggttcggtcttcggaacc

SEQ ID NO: 312083 - DNA, 740 bp, Homo sapiens
  misc_feature: GZ8MTXP01E1HQ8.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctcgcccgtcacccttggacacgccgcctccatctcctgcaggtcaagtcagacgtcccttcgttacaacgaataaagtacgggaaacctaccttacttggagtttggttcagcaggacggccagccaatcacgagctacttaattagtaggttcgaggcggtactcgtcgggtaccagaccagtatcgaggcgacgaggtcgggtacagggcgtcttagtactttcaacgtacgtaggaaacgtaagtcgaaggcgggtaagggggtaggacgggtacgttaagggaaaggttaaggtttcgggggtttaaccggggttttaattacggtaggtacgtaagggtacggtaaccgggtaaggggtttaaccgtaggggttcgggttcccgggttaccccgttaccgggtcccgttaaccgggtacgtttaaccgggggttacccgggggaaccgggggaaaccgggggtaaacccgggttaaaagggggttcggaaacggtaaaccgtaaaaccgtaaaacgggtaccggttgggttacggtccgttaacggtaacccc

SEQ ID NO: 312084 - DNA, 535 bp, Homo sapiens
  misc_feature: GZ8MTXP01EEDD3.11.28.C06.1.454.CMB.2.raw
  modified_base (412)..(412): a, c, t, g, unknown or other
  misc_feature (412)..(412): n is a, c, g, or t
  modified_base (480)..(480): a, c, t, g, unknown or other
  misc_feature (480)..(480): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataatgggaacactacttgagttggttcagcagaggccaggccaatctccaaggcgacctaatttataaggtttctaggcgggactcgtggggtcccagaccagattcgagcggacaggtgggtcagggcgctgatttcacactgagatcagcgagggtggagctgaagngtggttcggggtttattacgtgcagtgcgagggtacagttgtggtccttcgctcgcgttagttcgggnggacgggaccgaagggttggagaatacgaaacgtacgtgttcggtcttcggaacc

SEQ ID NO: 312085 - DNA, 613 bp, Homo sapiens
  misc_feature: GZ8MTXP01DLR2Q.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctcctgcaggtcaagtcagacgtcctcgttcacgataagtgggaacacctacttgagttggttcagcagacgccaggccaaatctaccgaaggcgtacttaaatttagtaaggtttcaggcgggactcgtggggtacccagtaccagtattcgagcggacagggtcgggtcagggcgctagactttcgaacactagaagaacgtcaaggcgaagggggtggaggtgtaggaaagtgttagggttacggggttttattacgtggctaagtggacgtaggggtacaggtggtcgggtcccttcgcgtcgtcgacgggttcgggacggggtaaacggggaaccgttaaaggggttggaacgtaactaacgtaaaaccggtaagtggttcgggtaacttcggaaccc

SEQ ID NO: 312086 - DNA, 548 bp, Homo sapiens
  misc_feature: GZ8MTXP01BOCST.11.28.C06.1.454.CMB.2.raw
  modified_base (293)..(293): a, c, t, g, unknown or other
  misc_feature (293)..(293): n is a, c, g, or t
  modified_base (490)..(490): a, c, t, g, unknown or other
  misc_feature (490)..(490): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacagccggcctccatcctcctgcaggtcaagtcagagcctcgttcaacgaataatgggaacacctacttgagttggttcagcagagccagcaatcncaagcactaatttataaggtttcaggcggactcgtggggtcccagaccagtatcgagcggacaggtgggtcagggcgctgtatttcacactgaagaatcgagcgaggggtggaggctagaagagtggttacggggtttattacgtgacagtgcgtagggtacgtagtgtggtccttcgctcgcgttaggttccgggngggtacgggaacgagggttggagaatacgaaacggtaacgtggttaggcgttggaacc

SEQ ID NO: 312087 - DNA, 571 bp, Homo sapiens
  misc_feature: GZ8MTXP01AEOKK.11.28.C06.1.454.CMB.2.raw
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtggaacacctattgagttggttcagcagacgccaggcaatctaccaaggcactaatttataaggtttcaggcgggacttcgtggggtcccagacccagattcaggcgnaggtggtcagggcnctgatttcacnctgagaatcagcgaagggtggagcgtagaagtagtggttacggggtttattacgtggcagtcgcgtagggtacaggtgtcggtccttcgcgttcgcgttacggttcgggacgggtaaaggggaacccgaaggggttcggaacggaacgttacgaaaacgtaacggtggttacgggtcgttaacggaaccg

SEQ ID NO: 312088 - DNA, 557 bp, Homo sapiens
  misc_feature: GZ8MTXP01CB9XF.11.28.C06.1.454.CMB.2.raw
  modified_base (277)..(277): a, c, t, g, unknown or other
  misc_feature (277)..(277): n is a, c, g, or t
  modified_base (490)..(490): a, c, t, g, unknown or other
  misc_feature (490)..(490): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttgttcagcagnggccaggccaatctaccaaggcgaccttaatttataaggtttcaggcggtactcgtggggtcccagacagtatcgagcggacaggtgggtcagggcgctgagtttcactactagagaatcgaggcgagggtagggaggcgtagaagagttgggttcggggtttaattacgtgtactagtggcgtagggtactaggtgtcggtcgttcgctcgnttacgtcgggcggtacgggacgaagggttggagtaatacgaaacgacgtggttcggcgttgaacccg

SEQ ID NO: 312089 - DNA, 524 bp, Homo sapiens
  misc_feature: GZ8MTXP01DG2PO.11.28.C06.1.454.CMB.2.raw
  modified_base (369)..(369): a, c, t, g, unknown or other
  misc_feature (369)..(369): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataatgggaacactacttgagttggttcagcagaggccaggccaaatctccaaggcgcctaatttataaggtttctaggcgggactctggggtcccagaccaggattcagcggcagtggtcagggcnctgatttcacactgagatcagcagggtgagctgaagatgtcggggtttattacgtgcatagcgaggtagaagtgtggtcgtcgcgtcgcagttcggcgggacgggaccggaaggttgggaggaagtacgaaacgaacgtagttggtccggcgtcg

SEQ ID NO: 312090 - DNA, 638 bp, Homo sapiens
  misc_feature: GZ8MTXP01EX8ZT.11.28.C06.1.454.CMB.2.raw
  modified_base (298)..(298): a, c, t, g, unknown or other
  misc_feature (298)..(298): n is a, c, g, or t
tcagcgagagataccacgaccggtgctcgatttagagctcacgtattgggtttggggctgatcaggactcctcagttcaccttctcacaatgaggcctccctgctcagctcctggggctgctaatgctctgggtcccagtgtccaggtggggatgttgtgttgactcagtctcccactcctccctgcccgtcacccttggacagccgcctccatctctgcaggtcaagtcagacgtcctcgttcaacgataagtcgggaactacctattgagttgttcagcagacggccaggaccaanctaccgaaggctacttaaatttagtaaggtttcgagggcgggactcgtcggggtcccagaccagtatcgaggcggacgtaggtcgggtcacgggtccctgtactttcgactacgtagaagtaatcgaaggtcggaaggggtggagggtcgtaggaagtaggttcgggttaacggggtttattacggtgtacgtaagtcggacgtaaggtcgaggttcggtcggttccttccggcgttccggcgtaacggttccggggacgggttacgggaaaccggtaaggggttcggaaagttacgtaacgaaaacggtaacgttgggtacgacgtcgaacccgtaacg

SEQ ID NO: 312091 - DNA, 651 bp, Homo sapiens
  misc_feature: GZ8MTXP01EPTWA.11.28.C06.1.454.CMB.2.raw
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (439)..(439): a, c, t, g, unknown or other
  misc_feature (439)..(439): n is a, c, g, or t
tcagcgagagataccacgaccggtgctcgatttagagctcacgtattgggtttggggctgatcaggactcctcagttcaccttctcacaatgaggctccctgctcagctccgtggggctgctaatgctctgggtcccagtgtccaggtggggatgttgtgttgactcagtctccactcctccctgcccgtcacccttggacacgccgcctcatctcctgcaggtcaagtcagacgtccttcgttacaacgtaataaagtcgggaaacctaccttattggagttggttcagcagacgcagcaatcacaaggctacttaaatttagtaaggtttcaggcggactcgtcgggtaccagaccagtatcgagcganagtgggnagggctctagtatttcgaactacgtagaagaaactcgaaggacgtaagggggtggaaggtntaaggaaagtaggttagggtttacggggttttaattaacggttgacgtaagttcggacggtaagggtacgtagggttcggtcggtcccgtttcggcgtaacgtcgttacgggttccggggaacggggaaacggggttaaccgaaaggggttcgggaaagtaacggttaaacgaaaaccggttacggtagggttacgggcttaacggaacccg

SEQ ID NO: 312092 - DNA, 632 bp, Homo sapiens
  misc_feature: GZ8MTXP01DSS99.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcaaccttggacagccgcctcatctcctgcaggtcaagtcagacgtcctcgttcacgataagtggaactactactgagttgttcagcagagccaggccaatcctaccgaaggctaccttaaatttagttaaggtttcgtaggcgggtactcgtaggggtcccagaccagtatcgagccggacgaggtggggcagggccgtcgtagtactttcaactacgtagaaggaatcgaagacggaaggggtggaggcgtaggaaagtaggttacgggttacggggttttaattacgtggtactaagtcggacggtagggttacgtagggttcggtcggtccttcggccttcggcgttacgggttccgggacggggtaacggggtaaccgaaggggttcggaaacgtaacgtaaacggaaaccggtaagtcgggttacgccgttcggaaccc

SEQ ID NO: 312093 - DNA, 595 bp, Homo sapiens
  misc_feature: GZ8MTXP01EUWLU.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccttggacagccggcctccatctcctgcaggtcaagtcagacgtccttcgttcacgaataagtgggaaactacctattgagttggttcagcaggacggccaggccaaatcctacgaaggctaccttaaatttagtaaggtttcagggcggactcgtggggtcccagaccaggtatcgagcggacaggtgggtacagggcgtctgtactttcaacacgtgaacgaatcgaggcgtaaggggtggaggctaggaagtagttgggttacggggtttaatcgtgcagtgcgtagggtactaggtcggtcggtcccttcgcgtcgtacgttacggttcgggaacggaaacggggaacgaagggttggaacgtaagtacgaaaacgtacgtgacggtcttaacgaaccg

SEQ ID NO: 312094 - DNA, 598 bp, Homo sapiens
  misc_feature: GZ8MTXP01C5928.11.28.C06.1.454.CMB.2.raw
  modified_base (439)..(439): a, c, t, g, unknown or other
  misc_feature (439)..(439): n is a, c, g, or t
tcagcgagagataccacgaccggtgctcgatttagagctcacgtattgggttttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctcctgcaggtcaagtcagacgcctgttcacgataagtgggaacactacttgagttggttcagcagaggccaggccaaatctaccaaggcgtccttaaatttataaaggtttcaaggcgggtactcgtcggggtcccagtacccagtattcgaggcggacagggtggggtcagggcgtctgtatttcactactgagtaatcgagacgaggggtggaggcgtaggaaagngtgggttacggggtttaattacgtggtacagtgacgtagggtactaggtgtggtccttcggccttcggcgttaggttccgggcgggaacggggacccgaaagggttgggaagtaacgtaaccgaaacgggtaaccgtggttacgggtcgttcggaaccc

SEQ ID NO: 312095 - DNA, 565 bp, Homo sapiens
  misc_feature: GZ8MTXP01AY5Z1.11.28.C06.1.454.CMB.2.raw
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacagccggcctccatctcctgcaggtcaagtcagacgcctcgttcacgataagtgggaacactacttgagttggttcagcagaggccaggccaatctaccaaggcgaccttaatttataaggtttcaggcgggactcgtggggtacccagacccagattcgagcggacaggtgggtcagggcnctgtattcacactganatcgagcgagggtggaggcgtagaagagtggttacggggtttatacgtgcagtgacgtagggtacgaggtggtggtccttcggctcgcgttaggttcgggacgggtaggggaaccgaagggttacggaggtaagtacgaaacggacgtggttacggtcgttcgtaaccg

SEQ ID NO: 312096 - DNA, 519 bp, Homo sapiens
  misc_feature: GZ8MTXP01APZPY.11.28.C06.1.454.CMB.2.raw
  modified_base (456)..(456): a, c, t, g, unknown or other
  misc_feature (456)..(456): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
  modified_base (507)..(507): a, c, t, g, unknown or other
  misc_feature (507)..(507): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcaacgataatgggaacacctacttgagttggttcagcagaggccaggccaatctccaaggcaccttaatttagtaggtttcaggcggactcgtggggtcccagaccagattcgagcggcaggtgggtcagggcgctgtattcacgatgagaatcagcgaggggtggaggctagaagtagtggttacggggtttatacgtgactagtgcgaggtacgngtgtcgctcgntcgnttgtcggcggaggacgaggttgagaacgacgaacgngtggcgtcgcgc

SEQ ID NO: 312097 - DNA, 606 bp, Homo sapiens
  misc_feature: GZ8MTXP01D5XDC.11.28.C06.1.454.CMB.2.raw
  modified_base (500)..(500): a, c, t, g, unknown or other
  misc_feature (500)..(500): n is a, c, g, or t
  modified_base (533)..(533): a, c, t, g, unknown or other
  misc_feature (533)..(533): n is a, c, g, or t
tcagcgagagataccacgaccggtgctcgatttagagctcacgtattgggtttggggctgatcaggactcctcagttcaccttctcacaatgaggctccctgctcagctccgtggggctgctaatgctctgggtcccagtgtccaggtggggatgttgtgttgactcagtctccactcctccctcgcccgtcacccgttggaccacgcccggcctccatcctcctgcaggtacaagtcagacgtcccttcgttacaacgaataagtgggaaacacctacttgagtttggttcagcagacggccaggccaaatcctaccgaaggccgtaccttaaatttagtaaggtttcgtagggcgggtactcgtcggggtcccagacagtatcgagcggacgaggtggggtcagggcgtctgtactttacaactacgtagaagaatcgaggcgtagggggtaggaggtcgtaggaagtagttgggttacgggttttatacgtgctagngacgtagggtataggtgtgtccgttcgcgtcgnttggttcgggacgggacgggtacgaagggttcggagtaataacgaaacggtacgtggttaggtcttggaaccc

SEQ ID NO: 312098 - DNA, 566 bp, Homo sapiens
  misc_feature: GZ8MTXP01CZJQG.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctcccactctccctgcccgtcacccttggacagccggcctccatctcctgcaggtcaagtcagagcctcgttcacgataatgggaacacctacttgagttggttcagcagaggccaggccaatctccaaggcgtacctaatttataaggtttctaggcgggtactcgtggggtccagaccaggattcgagcggacaggtgggtcagggcgctgatttcaacactgagaatcgagcgaaggggtggaggctaggaagtagttgggttacggggttttaattacgtagctaagtgacgagggtactaggtggtggtccttcgcttcgcgttagttccgggcgggaacggggaccaagggttggagtaagtacgaaacggacgtggttggtcgttggaacc

SEQ ID NO: 312099 - DNA, 938 bp, Homo sapiens
  misc_feature: GZ8MTXP01CG0R9.11.28.C06.1.454.CMB.2.raw
  modified_base (201)..(201): a, c, t, g, unknown or other
  misc_feature (201)..(201): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccttggacngccggcctccatctcctgcaggtcaagtcagacgtccttcgttacaacgtaataaagtacgggaaacctaccgttacttggaaggtttggtttaccagtccgaagggacggaccccgaaggacccctaaagttcccgtacccgaaacggggtccccgtaaccttttaaaagttttaacggttaaacgggtttttaccgtaacggggggtccggggtaaccttccgggttacggggggtaccccctaaaggaccccctagggtactttaccggacgggtccggtaacggtaaggggttcgggggtaccgaacgggggtccgtacgttagtaacttttccaaacgtaccgttaaggaagtaaacgtccggaaggtaccggggaaagggggggttcgggaaacgggtaccgttaaggggtaaaacggttagggtttacgggggtttttaaccgggggtttttaaagttacggttacggggtaaccgttaaggtttccggggaacggttaacccggggggttaaagtttacgggggtttaccgggttccggggttacccccgtttaccgggtcccggttcccgggtaccgtttaaaccgggggtttacccgggggacgggggggtaaaaacccgggggtaccgggttaaaaggggggtttcggaaaacccgggtaaacgttaaaccgggtaaaaaccgggttaacggttcggggttacgggtccgttaacgggtaaccccg

SEQ ID NO: 312100 - DNA, 641 bp, Homo sapiens
  misc_feature: GZ8MTXP01AQI21.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacagccgctccatctctgcaggtcaagtcagagccttcgttacaacgataagtgggaaactacctacttgagttggttcagcagacgccaggccaaatctacgaaggctacttaatttagtaggtttctaggcgggtactcgtggggtcccagacagatcgacgcgacagggtcgggtcacgggcgctagtactttcactacgtagaatatcgaaggcggaggggtggaacggtcgtaggaaaggttcgttagggtttacggggtttaacttacgtggtaacaggttggaaccggtgggttaagtaggtcggttcgtccgttcgcgttccggcgttagggttcccgggacggggtaaacgggtaaccggaaaggggttgggaacgtaaaccggttaacgaaaaacccggggtttcggtcggggttccggtaaccgttcggaacc

SEQ ID NO: 312101 - DNA, 521 bp, Homo sapiens
  misc_feature: GZ8MTXP01DMFE7.11.28.C06.1.454.CMB.2.raw
  modified_base (415)..(415): a, c, t, g, unknown or other
  misc_feature (415)..(415): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaaatctccaaggcgcctaaatttataaggtttctaggcggactcgtggggtcccagaccagatcgagcggcaggtgggtcagggcgctgatttcacactgagaatcagcgagggtggaggctagaagngtgtcggggtttattacgtgcatgcgagggtacaggtgtggccttcgctcgcagttcgggcggagggacaagggttggagaatacaaacggactggttgcttgaac

SEQ ID NO: 312102 - DNA, 616 bp, Homo sapiens
  misc_feature: GZ8MTXP01CZIU6.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctctgcaggtcaagtcagacgtcctcgttacaacgataagtgggaacactacttgagttggttcagcagacggccaggccaaatctaccaaggccgtacttaaatttagtaaggtttctaggcgggtactcgtcggggtccagaccaggtattcgagcggcaggtgggtcagggcgcgtgtatttcaactacgtagaaggtaatcgaggacgagggggttagggagggtacgtaggaaaggtagtttagggttcgggggttttaattacgtggactagtggacgtaggtacgtaggtgtcggtccttcggctcgcgttaggttcgggacgggtaacgggaccgttaaagggttgggaacgtaactaacgtaaacggtaacgtggttacgggtcttaacggtaaccc

SEQ ID NO: 312103 - DNA, 580 bp, Homo sapiens
  misc_feature: GZ8MTXP01AX2D3.11.28.C06.1.454.CMB.2.raw
  modified_base (379)..(379): a, c, t, g, unknown or other
  misc_feature (379)..(379): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacagccggcctccatctcctgcaggtcaagtcagacgcctcgttcacgataagtggaacactattgagttggttcagcagcggccaggccaatctacaaggcctactaaatttataaggtttcagggcgggtactcgtcggggtcccagaccaggtattcaggcggacaggtggtcagggcnctgtatttcactacgtgaagaatcgaggtcggaggggtgggaggtcgtaaggaagtagttcgggtttacggggtttaatacgtgactagtgcgtagggtacaggtgtcggtccttcgctcgcttaggttccgggcgggaaacgggtaccgaggggttggaacgtaacgaacgaaaccgtaggtggttacgggcttcgaacc

SEQ ID NO: 312104 - DNA, 591 bp, Homo sapiens
  misc_feature: GZ8MTXP01AK9L5.11.28.C06.1.454.CMB.2.raw
  modified_base (368)..(368): a, c, t, g, unknown or other
  misc_feature (368)..(368): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatctcctgcaggtcaagtcagacgtcctcgttacaacgaataagtgggaaaccacctacttgagttggttcagcagacgccagccaatcacgagctacttaattagtaggttcaggcgtactcgtcggtccagacagatcgagcggacagggtcgggnacgggctgtgtacttcaactactagaagtatcgagaggacgggtaggagtcgtaggaagtacggttggtttacggggtttatacgtggactaagtcgaggtagggtacgtacggtgtcgggtccttcggcgtcgacgttggtaccggggacgggaacgggtaaccgaggggttcggaacgtaacgtaaccgaaacgtacgtgggttaccgtcgttcgaacccg

SEQ ID NO: 312105 - DNA, 637 bp, Homo sapiens
  misc_feature: GZ8MTXP01EX3T0.11.28.C06.1.454.CMB.2.raw
  modified_base (534)..(534): a, c, t, g, unknown or other
  misc_feature (534)..(534): n is a, c, g, or t
  modified_base (556)..(556): a, c, t, g, unknown or other
  misc_feature (556)..(556): n is a, c, g, or t
tcagcgagagataccacgaccggtgctcgatttagagctcacgtattggggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacacgcccggcctccatcctcctgcaggtcaagtcagacgtcctcgttacaacgataagtgggaaactaccttattgagtttggttcagacaggacggccaggaccaatcctaccgaaggcctacttaaatttagtaacggtttcgagggtcggactcggtcggggtcccagacccagtactcgaggcggacgagggttcggggtacaggggtccgcgttaggtaactttccaacgtacgttagaaggtaaatcgaggacggaagggggttacgggaggtacgtaggaaagtagttgggttacggggtttattacgtgacgtagtggcgaagggtnaggttcgtcggtccgtttcggntccggtagttacggtcgggagggacgggaaacgttagggttggaagtaactacgaaaacgtgttggacgtcgttcgaaccg

SEQ ID NO: 312106 - DNA, 613 bp, Homo sapiens
  misc_feature: GZ8MTXP01DE204.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgccccgtcacccttggacagccggcctccatctcctgcaggtcaagtcagacgcctcgttacacgaataagtgggaaaccacctacttgagttggttcagcagaggccaggccaaatcctaccaaggcgtaccttaaatttagtaaggtttctagggcgggtactcgtggggtcccagaccagattcgagcggacaggtgggtcagggcgctgtactttcgaactacgtagaagaatcgaggacgaaggggtgggaggcgtaggaaagtagttagggttacgggggtttatttaacgtgtactagttgcgtagggtacgtaaggttggtcggtccgttcgcgtcggtcgttaggtttccgggacgggtacgggaccgttaaaggggttcggaagtaatacgaaacgtacgtggttacgggtcttcggaacc

SEQ ID NO: 312107 - DNA, 612 bp, Homo sapiens
  misc_feature: GZ8MTXP01DPX9K.11.28.C06.1.454.CMB.2.raw
  modified_base (376)..(376): a, c, t, g, unknown or other
  misc_feature (376)..(376): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctcatctctgcaggtcaagtcagacgtcctcgttacacgataattggaacacctattgagttggttcagcagaggccaggccaaatctccaaggcaccttaatttataaggtttctaggcgggactcgtggggtcccagaccagattcgagtcggcaggtgggtcagggcgntgatttcgaacacgtgagaatcgaggcgagggtgggaggcgtaggaaagtagttagggttaccggggttttaatttacgtggtacaggttgaccgtagggttacgaaggttcggtcggtcccgtttcgcgttccggtcgttacggtttccggggacggggtaacgggggacccgaaaggggttcggggaaagtaagtaaacggaacggtaacgtcggttagggtccttgggaaccc

SEQ ID NO: 312108 - DNA, 563 bp, Homo sapiens
  misc_feature: GZ8MTXP01BPYZM.11.28.C06.1.454.CMB.2.raw
  modified_base (200)..(200): a, c, t, g, unknown or other
  misc_feature (200)..(200): n is a, c, g, or t
  modified_base (417)..(417): a, c, t, g, unknown or other
  misc_feature (417)..(417): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacngccggcctccatctcctgcaggtcaagtcagacgcctcgttcaacgaataagtcgggaacacctacttgagttggttcagcagagccaggccaatctcaaggcacttaaatttataaggtttctagggcggtactgtcggggtccagacccagatcgagcggacagtgggcagggctctgattcacactgaagatcagcgaggggtgagctagaagngttggtacgggtttatacgtgcagtgcgagggtactaggtgtcggtccttcgcttcggcttaggttcgggacgggaacgggaaccgaaggggttggaacgtaacgtaacgaaaacggtaacgtggggttacgtcgttcggaacccg

SEQ ID NO: 312109 - DNA, 599 bp, Homo sapiens
  misc_feature: GZ8MTXP01CECY3.11.28.C06.1.454.CMB.2.raw
  modified_base (492)..(492): a, c, t, g, unknown or other
  misc_feature (492)..(492): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctcatctcctgcaggtcaagtcagacgcctcgtacacgaataagtgggaactacctaattgaggttggttcagcagacggccaggccaaatcctaccaaggcctaccttaaatttataaggtttcaagggcgggtacttcgtggggtcccagaacccagattcgaaggcggacagggttgggcagggcgctagatttcaactactgaagaatcaggcgaaggggtgggaggctaggaaagtagttgggttacggggttttataacgttggctaagtgcgtaggggtanagtggtggccttcgggctcgggcttaaggttcgggacgggtaagggaccgttaaaggggttggaacggtaataaccgaaacgaacgttggcgggtaacttggaaccc

SEQ ID NO: 312110 - DNA, 596 bp, Homo sapiens
  misc_feature: GZ8MTXP01BWHTA.11.28.C06.1.454.CMB.2.raw
  modified_base (278)..(278): a, c, t, g, unknown or other
  misc_feature (278)..(278): n is a, c, g, or t
  modified_base (383)..(383): a, c, t, g, unknown or other
  misc_feature (383)..(383): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgctcatctctgcaggtcaagtcagagtcctcgttcaacgaataagtgggaaacacctacttgagttgttcagcagngcaggcaatctacgaaggctaccttaatttagtaaggtttctacgggcggtactcgtcggggtccagacccaggtatcgaggtcgacgaggtgggtcaggggtcnctagtactttcacactagaagaatcgaagcgaaggggtggaggctaggaaaggtgttgggttacgggtttaagttacgtgtactaagtcggagtaacggggtagtaggtcggtcgtcccgtttcggcgttcgtcgacggtttcgggacgggaaacgggaacggagggttggaactaagtacgaaaacgtcgtaggttcggaacttcggaaccc

SEQ ID NO: 312111 - DNA, 546 bp, Homo sapiens
  misc_feature: GZ8MTXP01AHP1Y.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagcccggcctccatctcctgcaggtcaagtcagagcctcgttcacgataatgggaacacctacttgagttggttcagcagaggccaggccaatctccaaggcgcctaatttataaggtttctaggcgggactcgtggggtcccagacccagattcgagcggcaggtgggtcagggcgctgatttcacactgagaagtcggcgaggggtggaggcgtagaagtagtggtacggggtttattacggtgcagtgcgagggtacaggtgtggtccttcgctcgctagttcgggcgggagggaccgtaagggttgggagagtaacgaaacgaacgtggtggactgcctaaccg

SEQ ID NO: 312112 - DNA, 548 bp, Homo sapiens
  misc_feature: GZ8MTXP01C5KYS.11.28.C06.1.454.CMB.2.raw
  modified_base (359)..(359): a, c, t, g, unknown or other
  misc_feature (359)..(359): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctctgcaggtcaagtcagacgtcctcgttcacgataagtggaacactattgagttggttcagcagagcagcaatctcagctactaattataggtttcaggcggtactcgtggggtccagaccagatcgagcggacagtgggtcagggcntgattcacactgagatcgagacgaggggtggaggcgtaggaagtagttagggttacggggtttattacgtggacagtgacgtagggtacgaggttgtcggtccttcgcgtcgcgttaggtcgggcgggtaagggaccgaagggttggaagtaactacgaaacggtacgtggttacggtcgttcgaaccg

SEQ ID NO: 312113 - DNA, 596 bp, Homo sapiens
  misc_feature: GZ8MTXP01BCAT4.11.28.C06.1.454.CMB.2.raw
tcagcgagagataccacgaccggtgctcgatttagagctcacgtattgggtttgggctgatcaggactcctcagttcaccttctcacaatgaggctccctgctcagctccgtggggctgctaatgctctgggtccagtgtccaggtggggatgttgtgttgactcagtctccactctccctgcccgtcacccttggacagccgcctccatctctgcaggtcaagtcagacgcctcgttcaacgaataaagtgggaaactacctattgagtttggttcagcagacggccaggccaaatcctaccgaaggcgtacttaaatttagtaaggtttcaggcgggtactcgtggggtacccagaccagattcgaggcggacaggtgggtcagggcctcgtgtactttcactactgagaatcgagcgagggtgagcgtaggaagtgttggttacgggtttatacgtgctaagtgacgtagggtacgtaggttgtcggtcccttcggccgttcgcgttaggttccggggacgggtaaacgggaaccgttaagggttcggaagtaacgtacgaaaacgtacgtggttacggtcgttcggaacccg

SEQ ID NO: 312114 - DNA, 567 bp, Homo sapiens
  misc_feature: GZ8MTXP01DPVH2.11.28.C06.1.454.CMB.2.raw
  modified_base (294)..(294): a, c, t, g, unknown or other
  misc_feature (294)..(294): n is a, c, g, or t
  modified_base (431)..(431): a, c, t, g, unknown or other
  misc_feature (431)..(431): n is a, c, g, or t
  modified_base (507)..(507): a, c, t, g, unknown or other
  misc_feature (507)..(507): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctcatctctgcaggtcaagtcagacgcctcgttacacgaataagtgggaacacctacttgagttggttcagcagaggccaggccaaatcncaaggcgtacttaatttataaggtttcaggcggactcgtggggtcccagaccagatcgagcggacaggtgggtcagggcgctagtactttcaactacgtgaagaatcgaggcgaagggggtggaaggctaggaaagngttagggttacggggtttaattacgttggactagtgcgtagggtacagttggtcgtccttcgctcgcagttcgggnggtacgggacaaagggttggaagtaacgtaacgaaagtacgtggttcggtcgttcgaacc

SEQ ID NO: 312115 - DNA, 684 bp, Homo sapiens
  misc_feature: GZ8MTXP01EC69V.11.28.C06.1.454.CMB.2.raw
tcagcgagagataccacgaccggtgctcgatttagagctcacgtattgggtttggggctgatcaggactcctcagttcaccttctcacaatgaggcctccctgctcagctccgtggggctgctaatgctctgggtcccagtgtcagtggggatgttgtgttgactcagtctccactctccctcgcccgtcacccttggacagccggcctccatcctcctgcaggtcaagtcagagtcccttcgttacaacgaataagtacgggaaacctacctacttgagttggttcagcaggacggccaggccaaatcctaccgaacggccgtaaccttaaagtttaagttaacggtttcgtagggcgggtacgtcgtcggggtacccaggaccagtatcgaggcggacgaggtgggtacagggcgtcgtgtactttcacacgtagaagatcgaggcgagggggtggaggtcgtaggaaggtagttagggtttacgggggtttaatttaacggtgtacgtagtacggtacggtaagggttacgtagggttcggtcggtcccgttcggccgtcggtacgttacgggtttccgggacggggtaacggggtaaaccgttaagggggttcgggaaacggtaacgtaaacccggtaaaacggtacggtacggggttaggtcccgttaacggtaacccg

SEQ ID NO: 312116 - DNA, 604 bp, Homo sapiens
  misc_feature: GZ8MTXP01C4XNG.11.28.C06.1.454.CMB.2.raw
  modified_base (363)..(363): a, c, t, g, unknown or other
  misc_feature (363)..(363): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctcctgcaggtcaagtcagacgcctcgttacacgataagtgggaactactacttgagttggttcagcagagccaggccaatctaccaaggctacttaatttagtaaggtttctaggcggtactcgtcggggtccagacccagatcgagcgganaggtggtcagggccctgtacttcacactgaagatcgaggcgaggggtggaggtcgtaggaagtagttgggttacggggtttaattacggtgtacgtagttcggacgtaaggggtacgtaggttcggtcggtcccgtttcgcgttcggcgtacggttcggggacgggttaacgggaaccggtaagggttgggaacgttaacgtaacgaaaacgtcgttaggtcggacctcggaacctaaccg

SEQ ID NO: 312117 - DNA, 604 bp, Homo sapiens
  misc_feature: GZ8MTXP01DDWS3.11.28.C06.1.454.CMB.2.raw
  modified_base (397)..(397): a, c, t, g, unknown or other
  misc_feature (397)..(397): n is a, c, g, or t
  modified_base (422)..(422): a, c, t, g, unknown or other
  misc_feature (422)..(422): n is a, c, g, or t
  modified_base (534)..(534): a, c, t, g, unknown or other
  misc_feature (534)..(534): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccttggacagccggcctcatctctgcagtcaagtcagacgtcctcgttacacgaataaagtgggaaactacctacttgagttggttcagacaggaggccaggccaaatctaccgaaggcctacttaatttagtaaggtttctaggcgggtactcgtcggggtccagaccagattcgaggcggacgtaaggtcggggtacagggcncgtgtaactttcaactactaggaanaactcgagcggaaggggtggaggacgtaggaagtagttaggggttacgggtttaagttaacgtggtacgaagttgaccgtagggttacagggttgtcggtcctcgcgttcgngttacggttcgggacggtaacgggcgttaagggttgagtaacacgaacgtagtcggttagtcgttgaacc

SEQ ID NO: 312118 - DNA, 753 bp, Homo sapiens
  misc_feature: GZ8MTXP01A5JUB.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacagcccggcctcatcctctgcaggtcaagtcagacgccctcgttcaacgaataaagtcggggaaacctacctacttgagttggttcagtcaggacgccaggccaaatcctaccgaagggccgtaccttaaatttagttaaacggttttcgtagggtaccgggggtacttccggtacgggggtaccccaggaacccgtaaggtacttacgaagggccggaaccgaagggttcggggtccgaggggccgtcgttaggtactttcgaactacgtagaagtaaactcgaggcggtagggggtggaacggtcggtaaggtaaaggtaagtttcgggggtttaaccgggggttttaatttaacggtcggtaccgtaaggttacggaccggtaaggggttacgttaacggggtcgttacggggttcccgtttcggaccggttccgtaccggacggtttacgggggaccgggttaaacgggggaacccgttaaagggggttcgggaaacggtaacgttaacggaaaaccggtaaggtcgggttacgtcgttaacgggaacccg

SEQ ID NO: 312119 - DNA, 617 bp, Homo sapiens
  misc_feature: GZ8MTXP01AC53L.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatctcctgcaggtcaagtcagagcccttcgttcacgataagtgggaacacctactgagttggttcagcagcggccaggccaaatcctaccgaaggctaccttaaattttagtaaggtttcagggccgggacttcgtcgggggtcccaggacccaggattcgaggccggaatagggtcggggtcacggggctcctggtactttcgaacacgttagagtaatcgaagcgaggggtgaggtctaggaagtgtaggttcggggtttattactgcagttgcgtaggtacaggtggtcgtccttcgcgttaacgcgttacggttccggggacgggtaacgggacccgaaggggttgggaactaacggttaaccaaaacgggtaaccgtgggttacgggtccttaaggtaaccc

SEQ ID NO: 312120 - DNA, 530 bp, Homo sapiens
  misc_feature: GZ8MTXP01BNNEW.11.28.C06.1.454.CMB.2.raw
  modified_base (231)..(231): a, c, t, g, unknown or other
  misc_feature (231)..(231): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatctcctgcaggtcaagtcagancctcgttcacgataatgggaacactacttgagttggttcagcagaggccaggccaatctcaaggcgactaatttataaggtttctaggcggactcgtggggtcccagaccagattcagcgcagtgggtcagggcgctgatttcgacactgagaatcgagcgaaggggtggaggcgtagaaagagttggttacggggtttatacgttgctagtgcgaggtacagtgtggtcctcgcgtgcagttcgggcggagggaccgaagggttggagaagtacgaaacgactggttggcttggaacc

SEQ ID NO: 312121 - DNA, 560 bp, Homo sapiens
  misc_feature: GZ8MTXP01BHPQ9.11.28.C06.1.454.CMB.2.raw
  modified_base (204)..(204): a, c, t, g, unknown or other
  misc_feature (204)..(204): n is a, c, g, or t
  modified_base (499)..(499): a, c, t, g, unknown or other
  misc_feature (499)..(499): n is a, c, g, or t
tcagcgagagataccacgaccggtgctcgatttagagctcacgtattgggtttgggctgagctgggttttccttgttgctattatagaaggtgtccagtgtcaggtgcaactggtggaatcgtggggggaggcttggtcaagcctggggagtccctgagactctcctgtgcagcctctggattctccttcagtgacttctttangagttggatccgcaggctcgagggcaggggctggaatggatttcatacattggtgaaagtggcagtcccatataccacgcagactctgtgaagggccggttcaccatctcagggacaactaccaaaaactcaactatatctagaaatgactagcctgagctcgagacacggtccgtttatactgtgcgacgcccgcgatagcagcatcatctacgtcggggccgacggggaccctcggtcaccgtcctcctcctcgccctccaccgaacgggcccaagtccgttccttcccccgnggcccgcccgttcgcccttaccgaacgggcgcccgaacccgtccggacgcgccgaacccgg

SEQ ID NO: 312122 - DNA, 566 bp, Homo sapiens
  misc_feature: GZ8MTXP01DY5OL.11.28.C06.1.454.CMB.2.raw
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (529)..(529): a, c, t, g, unknown or other
  misc_feature (529)..(529): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctctgcaggtcaagtcagacgcctcgttacacgaataagtcgggaactacctattgagttggttcagcagagcagcaatcncaagcactattatagttnaggcggactcgtggccagaccagatcagcgacaggtggggtacagggcgtctaggtactttcaactacgtagaagtaagtcaaggcggtaaggggtgggaagggtcgtaagaaagtagttggggttacggggtttaattacgtggctaagtcggacgtagggtacaggtcggtggtcccttgacctggccaggttccgggaggaacgggacgttaagggnggaagaactacgaaaacgtactggcggtcttgaaccc

SEQ ID NO: 312123 - DNA, 564 bp, Homo sapiens
  misc_feature: GZ8MTXP01E1BBT.11.28.C06.1.454.CMB.2.raw
  modified_base (362)..(362): a, c, t, g, unknown or other
  misc_feature (362)..(362): n is a, c, g, or t
  modified_base (536)..(536): a, c, t, g, unknown or other
  misc_feature (536)..(536): n is a, c, g, or t
tcagcgagagataccacgaccggtgctcgatttagagctcacgtattgggtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgcaggctcgagggcaggggctggaatggatttcatacagttggtgaaagtggcagtcccatataccacgcagactctgtgaagggccgttcacatctcgaggacaactaccaaaactcaactatatctaggaaatgactagcctaaganctcgagacacggtcgtttatactgtcgcgacgcccgcgatagcagcatcatctacgtggggaccgacggggtaccctgggtccaccgtcctccctcgtcgccctaccgaaccgaccgggccctaacgtcccggttccttcccccgttggcccgtcccgcgccttccgaagggcncccgtaacccgccgagaacgccgaaccg

SEQ ID NO: 312124 - DNA, 570 bp, Homo sapiens
  misc_feature: GZ8MTXP01ANU91.11.28.C06.1.454.CMB.2.raw
  modified_base (422)..(422): a, c, t, g, unknown or other
  misc_feature (422)..(422): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacactacttgagttggttcagcagacggccaggccaatcctccaaaggccgtacctaaattttagtaaggtttccaagggcgggtactcgtgggggtcccagacccaggattcaggcggacagggtgggtcagggctcgtgtatttcacactgaacgatcgagcgtagggnggaggctaggaagtgtaggttcggggtttaattcgtggtacagtggcgtaggggtaactggtggtcggcctttcgcgttcgcttaggttcgggcggtaaggggaccaagggttggagaatacgaacgtagtggttacggcttggaacc

SEQ ID NO: 312125 - DNA, 586 bp, Homo sapiens
  misc_feature: GZ8MTXP01CG9L2.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgccccgtcacccttggacagccggcctccatctcctgcaggtcaagtcagacgcctcgttcacgataatgggaacacctacttgagttggttcagcagacggccaggccaaatctccgaaggcgtaccttaatttataaggtttctaggcgggtactcgtggggtcccagtaccagattcgagcggactaaggtcgggtcagggcgcgtgtactttcactactgaacgatcgagcgaggggtggaggcgtaggaagtagttagggttacgggggttttattacgtgtcgtaagtcggacgtagggtactagggtgtcggtccttcgctcggcttaggttccggggacggtagggaccgaagggttgggaagaagtacgaaacggagtggttacgtcgttgaacc

SEQ ID NO: 312126 - DNA, 559 bp, Homo sapiens
  misc_feature: GZ8MTXP01BV5OY.11.28.C06.1.454.CMB.2.raw
  modified_base (275)..(275): a, c, t, g, unknown or other
  misc_feature (275)..(275): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataagtggaacacctatgagttggttcagcagngccagccaatcacaaggcactaatttagtaaggtttcaggcggactcgtggggtcccagaccagattcgagcggacaggtgggcagggctctgtattcgacactgaagaatcgagcgaaggggtggaggcgtagaagtagttggttacggggtttattacgtgactagtgcgtagggtacaggtgtcggtccttcgctcggcttaggttcgggacgggtaagggaccgaagggttcggaagtaacgtaccgaaaacgtacgtcggttacgggtcttcggaaccc

SEQ ID NO: 312127 - DNA, 566 bp, Homo sapiens
  misc_feature: GZ8MTXP01BPTDV.11.28.C06.1.454.CMB.2.raw
  modified_base (486)..(486): a, c, t, g, unknown or other
  misc_feature (486)..(486): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgacctaaatttagtaaggtttctaggcgggactcgtggggtcccagaccagatcagcggcaggtgggtcagggcgctgatttcacactgacgaatcagcgaaggggtggaggctggaagatgggttacggggtttattacgtgcagtggcgtaggggtactaggtgtcggtccgtttcgcttcgcgnggttccgggcgggacggggtacccaaggggttggaacgaagttacgaaaacggtaacgtggttacggcgttcggaacccg

SEQ ID NO: 312128 - DNA, 614 bp, Homo sapiens
  misc_feature: GZ8MTXP01CDR0D.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatctcctgcaggtcaagtcagagcctcgttcacgataagtggaacactacttgagttgttcagcagcggccaggccaatctcaaggctacttaatttagtaaggtttctagggcggtactcgtggggtacccagacccagtattcgacggcggacgaagggtggggtcagggtcgctggtactttacactactagagtaatcgaggacgagggggtggaggtcgtaggaagtacgttgggttacggggttttaatcgtggctagtggacgtagggtactaggtggtcggtcctcgccgtcggcgttacgggtcggggaccggtaaaggggaccgttaaggggttcggttaaggtaacgtaaccggaaaacgtacgggttagggttacggtccgttcgtaacccg

SEQ ID NO: 312129 - DNA, 638 bp, Homo sapiens
  misc_feature: GZ8MTXP01CB9K3.11.28.C06.1.454.CMB.2.raw
  modified_base (401)..(401): a, c, t, g, unknown or other
  misc_feature (401)..(401): n is a, c, g, or t
tcagcgagagataccacgaccggtgctcgatttagagctcacgtattgggtttggggctgatcaggactcctcagttcaccttctcacaatgaggctccctgctcagctccgtggggctgctaatgctctgggtcccagtgtccagtggggatgttgtgttgactcagtcctccactcctccctgcccgtcacccttggacacgccggcctccatctcctgcaggtcaagtcagacgccttcgttcacgaataagtcgggaactacctacgttgagtttggttcagcaggacggccaggccaatctaccgaaggcgtacttaatttagtaaggtttcgtagggcggtactcgtcggggtacccagaccagtattcgaggcggacagggtgggcgagggcgngtgtactttacactactagagaatgagtcggaggggtggaaggtcgtaggaagtagttgggttacgggtttatacgtgactagtcgacgtagggtacgtaggttcggtcggtccgttccggtcgtccggtcgttacgggtttccgggggacggggtaaacgggggtaccgttaaagggggttcggaacggtaacgaacgtaaaaacggtacggtggttacgggtcgttcgtaacccg

SEQ ID NO: 312130 - DNA, 555 bp, Homo sapiens
  misc_feature: GZ8MTXP01EVI02.11.28.C06.1.454.CMB.2.raw
  modified_base (476)..(476): a, c, t, g, unknown or other
  misc_feature (476)..(476): n is a, c, g, or t
  modified_base (539)..(539): a, c, t, g, unknown or other
  misc_feature (539)..(539): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataatggaacacctacttgagttggttcagcagaggccaggccaaatctccaaaggcgacttaatttataaggtttcaggcggactcgtggggtcccagacagattcgagcggacaggtgggtcaggcgctagatttcacactgagaatcgagcgagggtggagcgtagaagtagtggttcgggtttagtacttggcagtgcgtagggtacaggtgtggtccttcgctcgcnggttcggggcgggtaaggggaaccgaagggttggaagtaacgtacgaaaaccggtaagtgggngtcgttaacggaaccg

SEQ ID NO: 312131 - DNA, 631 bp, Homo sapiens
  misc_feature: GZ8MTXP01A72Q6.11.28.C06.1.454.CMB.2.raw
  modified_base (394)..(394): a, c, t, g, unknown or other
  misc_feature (394)..(394): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccttggacacgcccggcctccatctcctgcaggtccaagtcagacgccttcgttacacgtataaagtcgggaacaccttacttgagtttcggttcagcaggacggccaggcccaaatcctacgaaggcctacttaaatttagtaaggtttcaaggcgggtacttcgtcgggggtacccagacccagattcgaggtcggaacngggtgggtcagggctctgtattcaactacgtgaagaatcgaggcggtaagggggtgggaggtcgtagaaagtgttgggttaccggggtttattacgtgactagtggacgtgggtacgaggttggtacgtccttcgcgtcgtcgttaacgggttccgggacgggaaacgggacgttaaaggggttcggaaacgggtaacttaaccggaaaacgtcggttgggacgccttaaggaaccc

SEQ ID NO: 312132 - DNA, 626 bp, Homo sapiens
  misc_feature: GZ8MTXP01DAQHS.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccactctcctgcaggtcaagtcagagcctcgttcacgataatgggaacacctacttgagttggttcagcagaggccaggccaatctccaaggcgtacctaatttataaggtttcgtaggcgggtactcgtcgggggtcccagaccaggtattcgaggcggacaggtgggtcgagggcgctgtaactttcgaacactagagaatacgagacgaggggtagggaggacgtagaagtagttacgggttacggggttttagttacgttggtctaagtgcggagggttacgtaaggttcgtcgggtccgtttcgtcgtccggtcgttacggttcgggaccggggaaggggtaacccggaaggggttggggaacgtaacgtaacgaaaacgggtaaccgtgggttacggtcgttcggtaacccg

SEQ ID NO: 312133 - DNA, 598 bp, Homo sapiens
  misc_feature: GZ8MTXP01AEVDN.11.28.C06.1.454.CMB.2.raw
  modified_base (483)..(483): a, c, t, g, unknown or other
  misc_feature (483)..(483): n is a, c, g, or t
tcagcgagagataccacgaccggtgctcgatttagagctcacgtattgggtttggggctgatcaggactcctcagttcaccttctcacaatgaggctccctgctcagctccgtggggctgctaatgctctgggtcccagtgtccagtggggatgttgtgttgactcagtctccactctccctgcccgtcacccttggacagccgcctcatctcctgcaggtcaagtcagacgcctcgttacaacgaataagtcgggaaactacctattggagtttggttcagcaggacggccaggccaaatcctacgaaggctacttaaatttagtaaggtttcaggcggtactcgtcgggtccagaccagattcgaggcgacgtaggtgggtcagggctctaggtactttcaacacgtgaagtaatcgaggcggtaagggggtggaacggtcgtaggaaagtagttgggttacgggtttaattcgtgctagngcgtaggtactaggtggtcggtccttcgcgtcgcgttagggttcgggacgggagggtaaccgaagggttggaagtaacgacgtaaacggtacgtgggttacgtcgttaacgaacc

SEQ ID NO: 312134 - DNA, 534 bp, Homo sapiens
  misc_feature: GZ8MTXP01A632Y.11.28.C06.1.454.CMB.2.raw
  modified_base (299)..(299): a, c, t, g, unknown or other
  misc_feature (299)..(299): n is a, c, g, or t
  modified_base (372)..(372): a, c, t, g, unknown or other
  misc_feature (372)..(372): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataatgggaacacctacttgagttggttcagcagaggccaggccaatctccaaggcnctaaatttataaggtttcaggcgggactcgtgggggtcccagaccagattcgagcggcaggtgggtcagggcnctgatttcacactgagaatcagcgaggggtggaggctagaagagtgttcggggtttatacgtggcagtgcgaggggtacaggtgtggtccttcgcttcgcttagttcgggacgggagggaccaagggttggagaatcgaaaacgactggttaggcttgaacc

SEQ ID NO: 312135 - DNA, 614 bp, Homo sapiens
  misc_feature: GZ8MTXP01BWKSO.11.28.C06.1.454.CMB.2.raw
  modified_base (438)..(438): a, c, t, g, unknown or other
  misc_feature (438)..(438): n is a, c, g, or t
  modified_base (554)..(554): a, c, t, g, unknown or other
  misc_feature (554)..(554): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacagccgcctccatctcctgcaggtcaagtcagacgcctcgttcaacgataatgggaacacctacttgagttggttcagcagacggccaggtcccaaatcctccaagggcgtaccttaaatttataaggtttcagggtcgggacttcgcggggtccagaccagattcgagcggacaggtgggtacagggcgtctgactttcaactactagaagtagacaaggcgaagggggttaggagggngttaggaaggtagttagggttaccgggggtttttaagttaacggtggtacctaggttggaccgaggggttacgtaggtgtcgggtccgtttccggctaacgcgttagttccggggngggaacgggtacgaagggttgggagaagtacgaaacgaacgtggttcgtcgttgaacccg

SEQ ID NO: 312136 - DNA, 563 bp, Homo sapiens
  misc_feature: GZ8MTXP01DK60Y.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctctgcaggtcaagtcagacgcctgttcacgataagtggaacacctacttgagttggttcagcaggacgccaggccaatctaccgaaggctaccttaaatttagtaaggtttctagggcggtactcgtggggtcccagaccagtatcgagcggacaggtgggtcagggctctgatttcactactgagaatcgagcgagggtggagctagaagtagttggttacgggtttatacgtggacagtgacgagggtacaggtgtcggtccttcgctcgtcttaggttcgggacgggtaacgggacgttaagggttggaacgtaataaccgaaacggtcgtggttcggtcttggaaccc

SEQ ID NO: 312137 - DNA, 696 bp, Homo sapiens
  misc_feature: GZ8MTXP01DNVEM.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacagccggcctccatcctcctgcagtcaagtcagacgcctcgttacacgtataatagggaacacctacttgagttggttcagcaggacggccaggccaaagtcctaccgaaggtcctaccttaaatttagtaaggtttctagggcgggtactcgtcggggtcccagaccagtagttcgagcggacaggtcggggtcacgggtccgtctgtactttcgactacgtagaagtagtcgaggacgtagggggtaggaacgggtcgtaggtaaaaggtcggtttaggggtttacccgggggttttaaatttacgttacggggtaacctaaggttcgaccgggtaacgggggtttaaccgtaagggtttcgggttccggtccccgtttcggacccgttcggtacgttaacggggtttccgggacggggtaaccgggaacggttaaagggttcgggaagtaacgtaacgaaaacggtacgttcggttacggggtccttggtaaccc

SEQ ID NO: 312138 - DNA, 573 bp, Homo sapiens
  misc_feature: GZ8MTXP01EJI7T.11.28.C06.1.454.CMB.2.raw
  modified_base (393)..(393): a, c, t, g, unknown or other
  misc_feature (393)..(393): n is a, c, g, or t
  modified_base (412)..(412): a, c, t, g, unknown or other
  misc_feature (412)..(412): n is a, c, g, or t
  modified_base (440)..(440): a, c, t, g, unknown or other
  misc_feature (440)..(440): n is a, c, g, or t
  modified_base (559)..(559): a, c, t, g, unknown or other
  misc_feature (559)..(559): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacagccggcctccatcctcctgcaggtcaagtcagacgcctcgttcaacgtataagtgggaactactacttgagttggttcagcaggacggccaggccaaagtcctaccgaaggctacttaaatttagtaaggtttctagggcggacttcgtggggtcccagaccagattcgagcggacagggtgggtacagggcncgtgtactttcacatgaanaatcgaagcgtaggggtgagctagaagngttggttacgggtttattacgtgcagtcgacgtagggtacaggtggtcgtccttacgcttcgcgttaggttccgggcgggtaagggaccaagggttcggagtaacgtacgaaacgtagngttaggcttgaacc

SEQ ID NO: 312139 - DNA, 654 bp, Homo sapiens
  misc_feature: GZ8MTXP01ENYAV.11.28.C06.1.454.CMB.2.raw
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (221)..(221): a, c, t, g, unknown or other
  misc_feature (221)..(221): n is a, c, g, or t
tcagcgagagataccacgaccggtgctcgatttagagctcacgtattgggtttggggctgatcaggactcctcagttcaccttctcacaatgaggctccctgctcagctcctggggctgctctgctctggtcccagtgtccagtggggatgttgtgttgactcagtctccactctccctgccctcaccctggacacgcgccacntcactcngagcagtacngagcctcgttctacgactaagtgtacgaacctacttgtagttggtttcgtagcagaggaccgacggaccgaactacctccaaccggagcccgttaactttaaagttaaggttttaccgaacgggttcgggggtaccggttcgtcggttcccccggaacgtaacccgaacggtaagtttcgtacggacggcctacggggttcggttcgggagacgtcggaacttcgttactacctacgtaggagaaacgtacgacgacgggtagggtggggaggtacggtaggtaaggtaaagtcggtttcgggtttaacgggtttcgttagtacgttccgagtacggacggtaggtaacgtggtccggtcgccgttcgcgcgttacggcgttcgggacggacgacggttaggagtaacgacaacgacgtagcgtggttcaacg

SEQ ID NO: 312140 - DNA, 575 bp, Homo sapiens
  misc_feature: GZ8MTXP01EPYVN.11.28.C06.1.454.CMB.2.raw
  modified_base (283)..(283): a, c, t, g, unknown or other
  misc_feature (283)..(283): n is a, c, g, or t
  modified_base (306)..(306): a, c, t, g, unknown or other
  misc_feature (306)..(306): n is a, c, g, or t
  modified_base (516)..(516): a, c, t, g, unknown or other
  misc_feature (516)..(516): n is a, c, g, or t
  modified_base (544)..(544): a, c, t, g, unknown or other
  misc_feature (544)..(544): n is a, c, g, or t
  modified_base (561)..(561): a, c, t, g, unknown or other
  misc_feature (561)..(561): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcaacgataatcgggaacacctacttgagttggttacagcaggnggccaggccaatctaccaaggcncctaatttagtaaggtttcagggccgggactcgtcgggggtacccagaccagtattcgaggcggacaggtcgggtcagggcgtctgtacttcactacgtgaacgtatcgagcggaaaggggtggagcgtaggaagtagttgggttacggggtttatacgtggacagtgcgtaggtataggttgtcggtccttcgcgtcgcgttgtcgggngggaacggggacaaggggttggagtaanaacgaaacgtacgtggngtccgttgtaaccg

SEQ ID NO: 312141 - DNA, 603 bp, Homo sapiens
  misc_feature: GZ8MTXP01D1S4R.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacagccgcctcatctctgcaggtcaagtcagacgtcctcgttacacgaataagtgggaaactacctacttggagttggttcagcagacggccagccaaatctaccaaggcgtacttaaatttagtaaggtttctaggcggtactcgtcggggtcccagaccagattcgagcgacaggtgggtcagggcgctagtactttcgaactagtagagaatcgaggcgaggggtgaggctagaagtgttagggttacgggtttaattacgtggtacagtgacgtaggtataggtgtcgtccttcgcgtcgtacgttacgggttcgggacggggtaaacggggaacccgttaaggggttcggaaagtaacgtaaaccgaaaacggtaacgtgggttacgcgttaacggaaccc

SEQ ID NO: 312142 - DNA, 581 bp, Homo sapiens
  misc_feature: GZ8MTXP01B1Z29.11.28.C06.1.454.CMB.2.raw
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacagccggcctcatctctgcaggtcaagtcagagcctcgttcacgataagtgggaacacctacttgagttggttcagcagaggccaggccaatctccaaggcgaccttaatttataaggtttcaggcgggactcgtcggggtcccagacccaggattcgagcggacaggtgggtcagggcnctgatttcacactgagatgagcgaggggtgaggctagaagngttggttacggggtttattacgtgcagttcgacgtagggtactaggtgttcggtccttcgcgtcgacgttaggttccgggacggggtaacggggaacccgttaagggggttggaacgtaagtaaccgaaacggtaacgtggttacgggtccgttggaacccg

SEQ ID NO: 312143 - DNA, 661 bp, Homo sapiens
  misc_feature: GZ8MTXP01CS74S.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgaatcagtctccactcctccctgcccgtcacccttggacacgccggcctccatctcctgcaggtcaagtcagacgcctcgttcaacgataagtcgggaacactacttgagttgttcagcaggacgccagaccaatctaccgaaggcgtaccttaaatttagttaaggtttcgtagggcggtactcgtacggggtcccagaccaggtattcgaggccggagagggtcgggtcagggcgtctggtactttacaactacgtagaagatcgagacggaggggtgggaggtcgtaggaagtagttacggggtttacggggttttaacttacggtaggtctaaggtcggacggtaaggggttaacgtgggttcggttccgggtcccgtttcggccgttcggaccgttacgggttccggggacggggtaaacgggggacccgaaagggggttcggaaggtaacgtaaccggtaaaacggtacgttgggttaccggtcgttcgaacccg

SEQ ID NO: 312144 - DNA, 578 bp, Homo sapiens
  misc_feature: GZ8MTXP01EGCJU.11.28.C06.1.454.CMB.2.raw
  modified_base (350)..(350): a, c, t, g, unknown or other
  misc_feature (350)..(350): n is a, c, g, or t
  modified_base (571)..(571): a, c, t, g, unknown or other
  misc_feature (571)..(571): n is a, c, g, or t
tcagcgagagataccacgaccggtgctcgatttagagctcacgtattggggtttggggctgatcaggactcctcagttcaccttctcacaatgaggctccctgctcagctcctggggctgctaatgctctgggtcccagtgtccagtggggatgttgtgttgactcagtctccactcctccctcgcccgtcacccttggacagccggcctccatctcctgcaggtcaagtcagacgcctcgttacaacgataagtggaactacctactgagttgttcagcagacgcagcaatctacaagcactaatttagtaagtttcgaggcggatcgtggggcccagaccagtatcgngcggacgtagtggggtcagggcgtctagtactttcaactacgtagaacaaagtcgaaggcggaaggggtgaggctaggaaagtgttaggttacgggtttattacgtggtactagtgacgaagggtacaggtggtcggtccttcggctcgtaattggttacgggcggggaaagggtaaccgaagggttggacgtaagtaaacgaacgtaacgtcggagtcgngtaaccc

SEQ ID NO: 312145 - DNA, 602 bp, Homo sapiens
  misc_feature: GZ8MTXP01CG4DH.11.28.C06.1.454.CMB.2.raw
  modified_base (399)..(399): a, c, t, g, unknown or other
  misc_feature (399)..(399): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacacgccggcctccatctcctgcaggtcaagtcagacgtccttcgttcaacgtaataagtcgggaacaccgtacttgagtttggttcagcaggacggccaggccaaatcctaccgaaggccgtaccttaaattttagtaaggtttctagggcggtactcgtggggtcccagaccagattcgaggcgcaggtgggtcagggcntgactttcaacactgagaatcaggcggaggggtcggaggcgtagagtagttggttacggggtttatacgtgctagtgacgtaggggtactaggttcgtcggtccttcggtcgtaacggcgttaggttccggggcgggtaaagggtaccgaaggggttgaagtaactaacgaaaccggtacgtgggttcggtcgttcgaacccg

SEQ ID NO: 312146 - DNA, 589 bp, Homo sapiens
  misc_feature: GZ8MTXP01BETOY.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacagccggcctcatctcctgcaggtcaagtcagacgcctcgttcaacgataagtgggaacacctacttgagttggttcagcagaggccaggccaatctacaggcaccttaatttagtaaggtttctagggcgggacttcgtcggggtcccagaccagattcgagcggacaggtgggtcagggcgctgatttcacacgtgagaatcgagcgaggggtggaggctaggaagtgtaggttacggggtttatacgtgctagtgacgtagggtactaggtggtcggtccgttcgcgtcgtcgttcggttccggggacgggtacgggaaccgaaggggttgggaaacgtaacgttaacgaaacggtaacggttcgggttacgggtcgttcgggaaccc

SEQ ID NO: 312147 - DNA, 802 bp, Homo sapiens
  misc_feature: GZ8MTXP01BU8WQ.11.28.C06.1.454.CMB.2.raw
  modified_base (201)..(201): a, c, t, g, unknown or other
  misc_feature (201)..(201): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccttggacngccgcctcatctcctgcaggtcaagtcagacgcctcgtacacgaataagtgggaaactaccttattgaggtttggttcagcgagacggccaggccaaatccacgaaggcgtaccttaaagtttagttaacggtttcgagggccgggtacttcggtcggggtaccccagaaccgagtattacgaggtccggacgaagggttcgggggtacaggggtccgtaccttaggtaacttttccgaaacgtacgttaggaaacgtaaacgttcgaagggtaccgggtaaaggggggtaggggtaacgggtacgttaagggtaaacgggttaaggttttacggggttttacggggggtttttaactttacggttaggtaacgtacggttacgggaaccggttaaagggggttaaccgttaaggggtttcgggtccggggtttacccgtttcccggtcccggttaaccggtacggttacggggtttaccccggggaaggggggtaaacccgggggtaaccggttaaaagggggttggggttaaaaccggtaaacgttaaacccggaaaacgttaaccgggttgggttaccgggtccgttccggtaacccg

SEQ ID NO: 312148 - DNA, 578 bp, Homo sapiens
  misc_feature: GZ8MTXP01ADR5A.11.28.C06.1.454.CMB.2.raw
  modified_base (556)..(556): a, c, t, g, unknown or other
  misc_feature (556)..(556): n is a, c, g, or t
tcagcgagagataccacgaccggtgctcgatttagagctcacgtattgggtttgggctgagctgggttttccttgttgctattatagaaggtgtccagtgtcaggtgcaactggtggaatcgtggggggaggcttggtcaagcctggggagtccctgagactctcctgtgcagcctctggattctccttcagtgactctttatgagttggatccgcaggctccgagggcaggggctggaatggatttcatacagttggtgaaagtggcagtcccatataccacgcagactctgtgaagggtccggttcaccatctaccgagggacaactaccaaaactcactatatctaggaaatgactagcctagagcgtcgaggacacggtctttattactgtcgcgaccggcccgaccgatacgcagcactcatcgtacgtcggggccggacggggtaccctggtccaccggtcctcccgtcgttcgccctccgaaccgaaccgggccctaacgttcccggttcccttcccccgcggtcccgcccttcgccttccgaagggcnccgacccgcgagcgcgaaccgg

SEQ ID NO: 312149 - DNA, 703 bp, Homo sapiens
  misc_feature: GZ8MTXP01AIQTV.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagcccggcctccatctcctgcaggtcaagtcagacgcctcgttcaacgataagtgggaactacctacttgagttggttcagcagacggccaggccaaatcctaccgaaggtccgtaccttaaatttagttaacggtttcgtagggcgggtacttcggtacggggtaccccaggaccagtacttcgacggcggactagggtgggtcaacgggtcgtcgtagtactttcgaacctacgtagaagtaactcgaaggacggtaggggtagggaacggtacgttaaggaaagttagggttagggtttacgggggttttaacttaccggttaggtacgtaagtttcggaccgtaaggggttaacgtagggttcggtcggtcccgtttcggccgtccggtcgttacgggttccggggacggggtaaacggggtaacccggaaggggttcgggaaacggtaacgttaaccggaaaacggttaccggtagggttcggtccgttcggtaaccccg

SEQ ID NO: 312150 - DNA, 586 bp, Homo sapiens
  misc_feature: GZ8MTXP01A3BZJ.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacagccggcctccatcctcctgcaggtcaagtcagagccctcgttcacgataagtgggaacacctattgagtttgttcagcagaggccaggccaatctaccgaaggcgtaccttaatttataaggtttcagggcgggactcggtggggtcccagaccagatcgagcggcaggtgggtcaggggctcgtgtactttcactacgtgaagaagtcgagcggaggggtggaaggcgtaggaagtagttgggttacggggtttatacgtgtacagtgacgagggtactaggtgtcggtccttcgcgtaacgtcgttaggtcgggacgggaacgggaccgttagggttcggaagtaacgaacgaaacggtaacgtggttcggaacttcggaaccc

SEQ ID NO: 312151 - DNA, 562 bp, Homo sapiens
  misc_feature: GZ8MTXP01EXEWT.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataatgggaacactacttgagttggttcagcagaggccaggccaatctccaaggcacttaatttataaggtttctaggcgggactcgtcggggtcccagaccaggtattcgagcggacaggtgggtcagggcgctgtactttcgacactgaagtaatcgagcgaggggtggaggctaggaagagttaggtcggggtttatacgtgcagtgcgtagggtacaggttcgtcggtccttccgctcggtcttaggttccgggacgggagggaaccgaggggttggagaactacgaaacggaacgtggttacggcgttcggaacc

SEQ ID NO: 312152 - DNA, 678 bp, Homo sapiens
  misc_feature: GZ8MTXP01A2RTQ.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacagccgcctccatctcctgcaggtcaagtcagacgcctcgtcacgataagtggaacactattgagttgttcagcaggacgccaggccaatctaccgaaggctaccttaaatttagtaaggtttcaggcggactcgtcggggtcccagacccagtatcgaggcggacgagggtgggtcagggctctgtactttcacacgtgaagtatacgaggacgtaggggtggaacgggtcgtaggaagtaaggttgggtttaccggggttttaattacggtggtacgtagttacggaccggtaaggggttacgtacgggttcgggttccgggttcccgtttccgggccgttccgggtaccggttacggggtttacccgggggaaccggggtaaacgggggtaaccccgttaaagggggttgggaaacgggtaaacgttaaccgggaaaaaccggtaacggttgggttacggtccgttaaggtaacccc

SEQ ID NO: 312153 - DNA, 621 bp, Homo sapiens
  misc_feature: GZ8MTXP01AUI1T.11.28.C06.1.454.CMB.2.raw
  modified_base (279)..(279): a, c, t, g, unknown or other
  misc_feature (279)..(279): n is a, c, g, or t
  modified_base (426)..(426): a, c, t, g, unknown or other
  misc_feature (426)..(426): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcccgcaggtcaagtcagacgcctcgttcacgataagtgggaacactacgttgagtggttcagcagnggccaggccaatctccaaggctactaatttataaggtttctagggcggactcgtcgggtcccagacagattcgaggcggctaagggtcgggtcagggcgtctgatttcaactacgtagaagaactcagggcgagggggtaggacggntaggaagtagttgggttacggggttttaattacgggtgacgtaagtcggacgtaggggtacaggttcggtcggtccccgttgccgttcggaaccgtaaggttcccgggggaacgggaacgggtaaacccgaaagggggttcggaagttacgtaacgtaaaacgtaaccgttggacggttactcggaacctaaccg

SEQ ID NO: 312154 - DNA, 604 bp, Homo sapiens
  misc_feature: GZ8MTXP01DCMRO.11.28.C06.1.454.CMB.2.raw
  modified_base (363)..(363): a, c, t, g, unknown or other
  misc_feature (363)..(363): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggattgttgtgttgactcagtctccactctccctgcccgtcacccttggacagcccggcctccatctctgcaggtcaagtcagactccctgttcaacggtaataaagtcggggaaacacctaacttggagttggttcagcaggaggccaggccaaatctaccaaggcctaccttaatttagtaggtttcaggcggacttcgtgggtcccagaccngattcgagcggcagtgggtcagggcgctgagtttcactacgtagagaatcgaggcgtaggggtacggaggtactggaaagtcgttagggtttaccggggtttattaccgtgctagtgacgtagggtactagggttcgtacggtccgttcgtcgtcggtcgttaggttcggggcggaaaggggttaccgaagggttggacgtaacgtaacgtaacgtacgtggttagccgttaacggtaacc

SEQ ID NO: 312155 - DNA, 623 bp, Homo sapiens
  misc_feature: GZ8MTXP01BKVFX.11.28.C06.1.454.CMB.2.raw
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
  modified_base (545)..(545): a, c, t, g, unknown or other
  misc_feature (545)..(545): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatcctctgcaggtcaagtcagacgtcccttcgttacaacgataaagtcggggaaacctaccttacgttggaggtttggtttcaaggcaggacggccaggccaaatcctaccgaaggctaccttaatttagtaaggtttcagggcggtactcgtcggggtcccagacagtatcgagcgganaggtgggcagggcncttaggactttcactacgtagaagtaatcgaggcggtaagggggtggaggtcgtagaagtagttgggttacgggtttattacgtgactagtggacgtaggggtacaggttgtcggtccttcgctcggcgttaggtccggggngggaaacgggaaccgttaaggggttcggaagtaacgttacgaaaacggtacgtgggttacggtaacttcgggtaaccc

SEQ ID NO: 312156 - DNA, 665 bp, Homo sapiens
  misc_feature: GZ8MTXP01BDM4J.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcaacgataagtgggaactacctacgttgagttggttcagcaggacggccaggccaatcctacgaacggccgtaccttaaagttttagtaacggttttccgtaaggggtccgggtaccttcggtacgggggtacccctaaggaccaggtacgttcgaggtccggacgtagggtcggggtcgacggggtcgtcttaggtactttacaactacgtaggaagtaacgtcgaaggtcggaagggggtggaacgtcgtaggaaagtgttgggtttaccgggtttaatcgtgacgtagtgaccgttagggatacgggttgtcggtcccttcggtactccggtcgttagggtccgggcggggtaaacgggtaccttaagggggttggaagtaacctacggaaaacgtcggtggacgggtaacccttgggaaccc

SEQ ID NO: 312157 - DNA, 722 bp, Homo sapiens
  misc_feature: GZ8MTXP01D9MKX.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtccagtgtccagtggggatgttgtgttgactcagtctccactcctccctgcccgtcacccttggacagccgcctcatcctctgcaggtacaagtcagacgcctcgttacaacgtaataagtcgggaaactaccttacgttgagtttggttcagcaggcgccgaggccaatctaccgaaggcctacttaatttacgtaagtttcgtaggcgggtacttcgtcggggtacccagaccagagttcgaggtccggcagggtgggtcacgggtcgctagtactttacactacgtagagtaatcgaggacggagggggttagggacggtacgtaaggaagttagttacggggtttaccgggggttttaatttacgtcgggtaactaacgggttcggaaccggttaaggggttaccgtaagggtttcgggttacccggggttcccgtttaccggtccggtttaacccggcggtttaaaccgggggtttaccgggggaccgggggtaaacggggttaaacccgggaaagggggtttacgggaaacgtaacgttaaaccggaaaaccggtaggttcggacggtaacgttcggtaacccg

SEQ ID NO: 312158 - DNA, 561 bp, Homo sapiens
  misc_feature: GZ8MTXP01E0K17.11.28.C06.1.454.CMB.2.raw
  modified_base (515)..(515): a, c, t, g, unknown or other
  misc_feature (515)..(515): n is a, c, g, or t
  modified_base (538)..(538): a, c, t, g, unknown or other
  misc_feature (538)..(538): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccttggacagccgcctccatctcctgcaggtcaagtcagacgtccttcgttcacgataaagtcgggaacacctacttgagttggttcagcagaggccaggcccaaatcctaccaaggcctaccttaaatttagtaaggtttctagggcgggtactcgtcgggggtacccagaccagattcgagcggcagggtgggtcagggcgctgtattcactactgaagaatcgaggcgagggggtggaggctaggaagtagttgggttacggggtttaatacgtgcagtgcgtagggtacaggtggtggcctcgctcgcttaggtcgggnggacgggacagggttggagtaanacgaaacgactggagtcgttgcc

SEQ ID NO: 312159 - DNA, 663 bp, Homo sapiens
  misc_feature: GZ8MTXP01B5YMY.11.28.C06.1.454.CMB.2.raw
  modified_base (201)..(201): a, c, t, g, unknown or other
  misc_feature (201)..(201): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtcctccactctccctgcccgtcacccttggacngccgcctcatctcctgcaggtcaagtcagacgccttcgttcaacgataagtcgggaactacctacttgagtttggttacagcaggacggccgaggccaatcctaccgaaggcctaccttaaattttagttaacggtttcgtaacgggcgggtacttcggtacgggggtccccagtaccgagtattcgaggccggtacgagggtcggggtcaggggtcgtctggtaactttcgacctacgtgaacgaagtcgaaggcggtagggggttagggagggcgtaggaaagtaggttgggtttaccgggggtttatttacggtgtacgtagtcggacggtaggggtactagggttcggtcgggttcccgttcgcgttccggcgttacggttcccggggacgggtaacggggaccgttagggggttcggagtaacgtacgaaacgtacgtggttacgtcgttggaaccg

SEQ ID NO: 312160 - DNA, 635 bp, Homo sapiens
  misc_feature: GZ8MTXP01D26E5.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatctcctgcaggtcaagtcagacgtccttcgttcaacgtataagtgggaactacctacttggagttggttcagcaggacggccaggccaaatctaccgaaggcgtaccttaatttagtaaggtttcgtaagggcgggtacttcgtcggggtacccagaccagtattcgagcggactaggtgggtcagggcgtacgtagtactttcgaactacgtagaagtaagtcgaagcggtaggggtggaggtctaggaagtagttagggttacggggtttaattacgtgtacgtagtgacgtagggtacgtaggtcgtcggtcccttcgcgtcggtcgttaggttccggggcgggaaacgggtaccggaagggttgggaacgtaacgttaaccggaaaacggtacggtcgggttacgtccgttcggaacccg

SEQ ID NO: 312161 - DNA, 692 bp, Homo sapiens
  misc_feature: GZ8MTXP01C648L.11.28.C06.1.454.CMB.2.raw
  modified_base (201)..(201): a, c, t, g, unknown or other
  misc_feature (201)..(201): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccttggacncgcccggcctccatctcctgcaggtcaagtcagacgtccctcgttacaacgaataaagtacgggaaacctaccttacgtttggaggtttggtttacaggaccgaggacggacccaaggacccaaatccgtaccgaaaggccgtacctttaaaagtttagttaaacgggttttcgtaaggggccgggtaaccgttccggtacgggggtcccaaggacccgaaggtacgttcgaacggtccgggaacgtagggtcggggtcaggggtcccgcttaggtactttcactacgtgaagaatcgaagcggaagggtgggagtcgtagaagtagttgggttacgggtttatacgtggactagtcgcgtagggtactaggttcggtcggtcccttcggcgtaacgcgttacgggttccggggacgggtaaacggggaccgttaagggttcggaacgtaacgtaacgaaacgtaacggtgttacggtcgttaacgaaccg

SEQ ID NO: 312162 - DNA, 645 bp, Homo sapiens
  misc_feature: GZ8MTXP01DO43C.11.28.C06.1.454.CMB.2.raw
  modified_base (430)..(430): a, c, t, g, unknown or other
  misc_feature (430)..(430): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccgttggacacgccggcctcatctcctgcaggtcaagtcagacgtccctcgttacaacgaataaagtcgggaaacaccttacttggagttggttcagcaggacggccaggccaaatctaccgaaggcctaccttaaatttagtaaggtttcgaagggcgggtactcggtcggggtacccagaccaggatcgagcggacaggtcggggtcagggctctagtactttcaactacgtagaanaatcgaaggcggaaggggtggaggcgtaaggaaacgtagttacgggtttacggggtttaattacgttgcgtaagtggacgtaagggtacgtaggttcgttcgggtccctttcgcgtcggcgttacgggttccgggaacggggtaaacgggaaccgaaaggggttggaacgtaacgtaacgaaaacggtaccgtgggttacggtcgttcggaaccc

SEQ ID NO: 312163 - DNA, 756 bp, Homo sapiens
  misc_feature: GZ8MTXP01B4WH1.11.28.C06.1.454.CMB.2.raw
tcagcgagagataccacgaccggtgctcgatttagagctcacgtattgggtttggggctgatcaggactcctcagttcaccttctcacaatgaggctccctgctcagctccgtggggctgctaatgctctgggtcccagtgtccaggtggggatgttgtgttgactcagtcctccacttcctccctgccccgtcacccgttggacacgcccgcctccatctcctgcaggtacaagtcagacgtcccttcgttacaacgtaataaagtcgggaaacctaccttacgttggaagtttggttccagacaggacggccaaggccaaagtccaccgaaaggcctaacctttaaatttaacgttaaggtttacgtaaggggccgggtaccttcggtccgggggtaccccagaacccgtaggtacttcgaacggcggactagggtcggggtacacggggtcctcgttaggtaacttttccgaaacctagttaggaagtaaactcgaaacgggcggtaagggggttgggaacggtacggttaaggaaagggttaggtttacggggttttaccgggggtttttaattacggtggtaccgtaaggttggaaccggtaggggttactacgggttcggtcggttccctttcgggcctaaccgggtcgttaacgggttccggggacggggaaacggggtaaccgttaaggggttaggaacggtaactaccggtaaaaacgtcggtggttacgggaaccttcggaacccg

SEQ ID NO: 312164 - DNA, 610 bp, Homo sapiens
  misc_feature: GZ8MTXP01CD3Z3.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccgttggacacgccggcctccatctcctgcaggtacaagtcagacgtccctcgttcaacgtaataagtacggaactaccttacttgaggtttgttacagcagacggccagccaatcaccgaaggctaccttaaatttagtaaggtttcgtagggcgggtacttcggtcggggtacccagaccagtattcgaggcggacgagggtgggtcgagggcgtctagtactttacgactacgtagaagatcgagcggaggggtggagtcgtaggaagtaggttgggttacgggtttatacgtgactagtgacgtagggtactaggtcgtcgccgttcgacgtcgtcggttaggtccggggacggaacgggcgttaaggggttgaagtaatacgaaacggtacgtggacggtcgttcggtaaccg

SEQ ID NO: 312165 - DNA, 546 bp, Homo sapiens
  misc_feature: GZ8MTXP01D8TW5.11.28.C06.1.454.CMB.2.raw
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
tcagcgagagataccacgaccggtgctcgatttagagctcacgtattgggtttggggctgatcaggactcctcagttcaccttctcacaatgaggctccctgctcagctccgtggggctgctaatgctctgggtcccagtgtccaggtggggatgttgtgttgactcagtctccactctccctgcccgtcacccttggacagccgcctcatctcctgcaggtcaagtcagagcctcgtacaacgaataagtgggaacacctacttgagttggttcagcagagcaggccaatctcaagcgactaatttataaggtttcaggcggatcgtggggtcccagacccagtatcagcggacaggtgggcaggcgctgatttcacactgagaananagngagggaggagngagaagagtgttaggttagttagtgnagngngaggtagtagtgtcgtcgtcgtcgtcgcgttacggtcgggacgggaacgggaacggaagggttaggaaggaacgtaaacgaaacgtaacgtacggttcggtcgttcgtaacg

SEQ ID NO: 312166 - DNA, 621 bp, Homo sapiens
  misc_feature: GZ8MTXP01BDBER.11.28.C06.1.454.CMB.2.raw
  modified_base (446)..(446): a, c, t, g, unknown or other
  misc_feature (446)..(446): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccttggacagcccgcctccatctcctgcaggtcaagtcagagtcctcgttcaacgataagtgggaacacccttatgagttggttcagcagaggccaggccaatcctccgaaggcgtaccttaatttagtaaggtttctagggcggacttcgtcggggtcccagaccagtatcaggccgacagggtcgggtcagggcgtctagacttttacgactactgaaggaatcgagcggaggggtggaaggcgtaggaagngttggtacgggggttttataacgtcggtacctaggtgtaccgtagggtacgtaggtcggttggtccctttcggctcggcttacgggttacgggcgggtaaggggaaccgttaaaggggttggaacggtaagtaaccgtaaacggtacggtggttacgggtcgttaacggaacccg

SEQ ID NO: 312167 - DNA, 647 bp, Homo sapiens
  misc_feature: GZ8MTXP01BEQ04.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccttggacagcccggcctccatctcctgcaggtcaagtcagacgcctcgttcacgataagtcgggaacacctacttgagttggttcagcaggacggccaggccaatcctaccgaaaggccgtacctttaaatttacgttaaggtttcgagggccgggtacttcggtcggggtacccagtacccagtatcgaggcggacagggtcggtcgagggtcgtctgtacttcaacgtactagaagacgtcgaggcggtaagggggtacggaggtacgtaggtaaagtaggtttacggggtttacggggtttaattacgtaggtaccgtaagttcgggacggtaacgggttacgtaggttcggtccggttccttcggcgtcggtcgttacgggttcgggacgggtaacgggacgaagggttcgaagtaagacgaaacgtacgtggttcgtcgttcgaacccg

SEQ ID NO: 312168 - DNA, 612 bp, Homo sapiens
  misc_feature: GZ8MTXP01AIUHV.11.28.C06.1.454.CMB.2.raw
  modified_base (201)..(201): a, c, t, g, unknown or other
  misc_feature (201)..(201): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccttggacngcccggcctccatctcctgcaggtcaagtcagacgtccctcgttacacgaataagtgggaaacacctacttgagttggttcagcagacggccaggccaaatcctaccaaggctaccttaatttagtaaggtttcagggcggacttcgtcgggggtcccagacccagattcgaggcggacgagggtgggtcgagggcgctgtactttcacactgaagactcgaggtcgaggggtggaacggtcgtaggtaagtagttgggttacgggtttattacgtgtacagtgcgtagggtactaggtcggtcggtccttcggcgttcgcgttacggttccgggacgggtaacggggaccgttaagggcggttaacgaacgtaacgaaaccggtacgtggttacggtccgttggaacccg

SEQ ID NO: 312169 - DNA, 592 bp, Homo sapiens
  misc_feature: GZ8MTXP01B58AX.11.28.C06.1.454.CMB.2.raw
  modified_base (402)..(402): a, c, t, g, unknown or other
  misc_feature (402)..(402): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctcccactctccctgcccgtcacccttggacagccggcctccatctcctgcaggtcaagtcagagcctgttcacgataatgggaacacctattgagttggttcagcagaggccaggccaaatctacccaaggcaccttaaatttataaggtttctaaggcgggactcgtaggggtcccagaccagattcgagcggacagtgggcagggcgctggatttcgacacgtgaagtaanacgaggacgaggggtaggagacgtagaagtagttagggttacggggtttaagttacgtggacagtagacgtagggtacgtaggtcggtcggtccgttcggcgtcggtcgttacggttcgggacgggaacgggaacgaagggttcggacgtaataaccgaaacgtaacgtggttacggtcgttcggtaacc

SEQ ID NO: 312170 - DNA, 606 bp, Homo sapiens
  misc_feature: GZ8MTXP01CQXEB.11.28.C06.1.454.CMB.2.raw
  modified_base (515)..(515): a, c, t, g, unknown or other
  misc_feature (515)..(515): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctctgcaggtcaagtcagacgtcccttcgttcaacgataagtagggaactacctacttgagttggttcagcagacggccgacggaccaaactcctaccgaacggcgtaccttaaatttaagttaaggtttcgtagcgggggggggtactcgtcggggtccagaccgagtatcgagcggcgtaggtcgggtcgaggcgtcgtgtacgttcacgtactagaagtaagtacgaggacggtaggggtagggaggacgtagtaagtagttggttacgggtttagttacgtgtcagtcgcgtaggtacgnggttgtcggtccgttcgcgtcgcgttggttcgggcgggaacgggacgagggttcggagaataacgaacgaacgtcggttcgcgttgaaccg

SEQ ID NO: 312171 - DNA, 580 bp, Homo sapiens
  misc_feature: GZ8MTXP01A1XGR.11.28.C06.1.454.CMB.2.raw
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctcctgcaggtcaagtcagagcctgttcacgataagtggaacacctattgagttggttcagcagagccaggccaaatctaccgaaggccacttaaatttataggtttcagggcggactcgnggggtcccagaccngatcgagcggacaggtggtcagggcgtntgtactttcgacactagagtaatcgagcgtaggggtggaggcgtagaagtagttggttacggggtttatacgtggactagtgacgtagggtacaggttgtcgggtcttcggcttcggcgttacggttccgggacggggtaagggaacccgttaaagggggttcggaacgtaacgtaaccgaaacgtacgtaggttcggtcgttcgcg

SEQ ID NO: 312172 - DNA, 638 bp, Homo sapiens
  misc_feature: GZ8MTXP01AKYGG.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacagccgcctcatctctgcaggtcaagtcagacgtccttcgttcaacgtataagtcgggaacctacctacttgagtttggttcagcgaggacggccaggccctaatcctaccgaagggcctaccttaaagtttacgtaaacggtttcgtaagggtccgggacttcggtcggggtacccagtacccgagtacttcgaggtccggagagggtgggtcagggctcgtagtacttacactacgtgaagaatcgaggtcggaagggggtggaaggtcgtaggtaaagtgttacggggtttacggggtttaattacgtggactagtggaccgtaggggtacagggttcgtcgtcccgttcgcgtcgcgttagggttccgggagggtaacgggacgaagggttggaacgtaactacgaaaacggcgtcggacgggtccttcggtaacc

SEQ ID NO: 312173 - DNA, 582 bp, Homo sapiens
  misc_feature: GZ8MTXP01AN56I.11.28.C06.1.454.CMB.2.raw
  modified_base (267)..(267): a, c, t, g, unknown or other
  misc_feature (267)..(267): n is a, c, g, or t
  modified_base (568)..(568): a, c, t, g, unknown or other
  misc_feature (568)..(568): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctcatctcctgcaggtcaagtcagagcctgtcaacgataatggaacactacttgagttggttnagcaggacgccaggccaaatctaccgaaggctacttaaatttagtaaggtttctaaggcggtactcgtggggccagaccagatcgagcgacaggtgggcagggcgtcgtagtactttacaactactaggtaagactacgaggcggtaaggggtggagacgtagaagtagttgggttacggggtttaattacgtgtacagtgcgaagggtactaggtcgtcggtccgttcgcgtcgcgttacggttcgggacgggaacgggaacgttaaggggttcggagaagtaacgaaacgtacgtaggnggtccgttgaaccg

SEQ ID NO: 312174 - DNA, 560 bp, Homo sapiens
  misc_feature: GZ8MTXP01A6GGO.11.28.C06.1.454.CMB.2.raw
  modified_base (280)..(280): a, c, t, g, unknown or other
  misc_feature (280)..(280): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacagccggcctccatctcctgcaggtcaagtcagagcctcgttcacgataagtgggaacacctattgagttggttcagcaggngccaggccaaatcctacaaggctaccttaaatttagtaaggtttcaggcgggtactcgtggggtcccagacccagtattcgaggcggacaggtgggtcagggcncgtgtactttcanacgtgaagatcgagcgtaggggtgagggtctaggaagtgttacggttacggggtttatacgtgctagtgcgtagggtacaggtgtcggccttgctcgtcaggtcgggcgggaagggaccgagggttgacgaatacggaaacgtacgtggttcgcgttgaaccg

SEQ ID NO: 312175 - DNA, 707 bp, Homo sapiens
  misc_feature: GZ8MTXP01BBEZE.11.28.C06.1.454.CMB.2.raw
  modified_base (290)..(290): a, c, t, g, unknown or other
  misc_feature (290)..(290): n is a, c, g, or t
  modified_base (573)..(573): a, c, t, g, unknown or other
  misc_feature (573)..(573): n is a, c, g, or t
  modified_base (599)..(599): a, c, t, g, unknown or other
  misc_feature (599)..(599): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccgttggacacgccggcctccatcctcctgcaggtcaagtcagacgcccttcgttcaacgaataaagtacgggaacaccttacgttgagtttggttanagcaggacggccgaggacccaaatcgtaccgaaggccgtactttaaaagtttagttaaggtttacgtagggtcggtacgttcggtcggggtccaagacccgagtattcgaacggcggtaacgtagggtcgggtacgacgggtacgcgttgtaactttccgaaacgtacgtggaaacgtaactccggaaggtcgggagggggtaggggaacggtacgtaggaagtagttacggggtttacggggttttaatacgtgtaccgtagtcgggtacggaagggttacngggttcggtcgggtccctttccgggngtccgtacgttaacgggttccggggacgggtaaacgggtaccgttaaggggttccggaagtaacgtaaacgaaaccgggtacgtgggttcgaaccgttcgggtaaccc

SEQ ID NO: 312176 - DNA, 800 bp, Homo sapiens
  misc_feature: GZ8MTXP01BL05H.11.28.C06.1.454.CMB.2.raw
  modified_base (165)..(165): a, c, t, g, unknown or other
  misc_feature (165)..(165): n is a, c, g, or t
tcagcgagagataccacgaccggtgctcgatttagagctcacgtattgggttttgggctgatcaggactcctcagttcaccttctcacaatgaggctccctgctcagctcctggggctgctaatgctctgggtcccagtgtccagtggggatgttgtgttgactnagtctccactcctccctgcccgtcacccttggacagccggcctccatctcctgcaggtcaagtcagacgtccttcgttacacgaataagtacggggaaacctaccgttacgttggtaggtttgggtttacaggaccgaggacgggcccgaacgggacctaaactccgtacccgaacgggtccgtaaccctttaaagtttttaagttaaacgggtttttccgtaaacgggggtcggggtaaccgttccgggtacgggggtaccccaacggaccccgtaaggtacgtttccgaagggtcccgggaacggtaacggggttcggggtaaccgtacggggtcccgtaccgttaggttaacttttccgaaaccgtacgtttaggaaagtaaacgtccggaaagggtcgggtaagggggttcggaagggtaccgttaagggaaaggttaggtttacggggtttaccgggggtttttaattacgtaggtacctaaggttcggaccgggtaagggttaccgtagggttcggtcgggttaccgtccggcgtccggacgttacggttcgggaccggggaacgggaccggttaaggggttgaacgtaacgtacggaaaccggtagtcgggcgtaaccgttcgaaccg

SEQ ID NO: 312177 - DNA, 562 bp, Homo sapiens
  misc_feature: GZ8MTXP01EL7JJ.11.28.C06.1.454.CMB.2.raw
  modified_base (242)..(242): a, c, t, g, unknown or other
  misc_feature (242)..(242): n is a, c, g, or t
  modified_base (394)..(394): a, c, t, g, unknown or other
  misc_feature (394)..(394): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgctcatctctgcaggtcaagtcagagcctgtcacgataanggaacactactgagttgttcagcagagccaggccaaatcacaaggcacttaaatttataaggtttcaggcggactcgtggggtcccagaccagatcgagcggacaggtgggtacagggcgctgtactttcaactacgtagaagaactcgagnggtaaggggtggaggctaggaagtagttagggttacggggtttattacgtggactagtgcgtagggtactaggtgtcggtccttcgcgttcgcgttagttccggggacggaacgggtaaccgaagggttggagaactacgaaaacgtacgtggttaggcttggaaccc

SEQ ID NO: 312178 - DNA, 554 bp, Homo sapiens
  misc_feature: GZ8MTXP01EE1MR.11.28.C06.1.454.CMB.2.raw
  modified_base (199)..(199): a, c, t, g, unknown or other
  misc_feature (199)..(199): n is a, c, g, or t
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (440)..(440): a, c, t, g, unknown or other
  misc_feature (440)..(440): n is a, c, g, or t
  modified_base (458)..(458): a, c, t, g, unknown or other
  misc_feature (458)..(458): n is a, c, g, or t
  modified_base (481)..(481): a, c, t, g, unknown or other
  misc_feature (481)..(481): n is a, c, g, or t
  modified_base (515)..(515): a, c, t, g, unknown or other
  misc_feature (515)..(515): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacngccgcctccatctcctgcaggtcaagtcagacgcctcgtcacgataagtggaacactattgagttggttcagcagngcagcaatcncaaggctactaatttagtaaggtttctaggcggactcgtggggtcccagaccagtatcgagcggacgaggtggggtcagggcgctgtacttcaactagtagaagaatcgagcgaaggggtggagctagaagtagtgggttacgggtttattacgngtacagtgacgtaggtanggtgtcggtccttcgcttccggngttacggtcgggacgggaacggtaacgttagggngaagtaactaacgaaacgtcgtggcgtaacgttcgaacc

SEQ ID NO: 312179 - DNA, 667 bp, Homo sapiens
  misc_feature: GZ8MTXP01ARTI4.11.28.C06.1.454.CMB.2.raw
  modified_base (440)..(440): a, c, t, g, unknown or other
  misc_feature (440)..(440): n is a, c, g, or t
  modified_base (478)..(478): a, c, t, g, unknown or other
  misc_feature (478)..(478): n is a, c, g, or t
  modified_base (532)..(532): a, c, t, g, unknown or other
  misc_feature (532)..(532): n is a, c, g, or t
tcagcgagagataccacgaccggtgctcgatttagagctcacgtattgggtttggggctgatcaggactcctcagttcaccttctcacaatgaggctccctgctcagctccgtggggctgctaatgctcgtgggtcccagtgtccgaggtggggatgttgtgttgactcagtcctccactcctccctcgcccgtcacccgttggaccacgcccggcctcatcctcgtgcgagtcaagtcaggacgtcccttcgttacaacggtaataaggtacgggaaactaccgttattggagtttggttacaggacaggacggccaacggccaaactccgtaccgaaggtcctacctttaaagtttagttaacggtttcgacgggtcgggtaccttcggcggggtacccagaccagtatcgaggcggacgagggtcgggcagggtccngttagtacttacgacacgtagaagtaacgtcgaacggngggaagggtgggacgtgtaggaagtaggttgggttacgggtttatagtcggtanaggttcgacggtagggtacgtggttcgtccgggtccttcggctcggtagttaccggggtacgggacgggtaaaccgggaaggaacggggttgaacggaagttaacgaacggttagccggttagccttaacggaac

SEQ ID NO: 312180 - DNA, 596 bp, Homo sapiens
  misc_feature: GZ8MTXP01ANWX9.11.28.C06.1.454.CMB.2.raw
  modified_base (238)..(238): a, c, t, g, unknown or other
  misc_feature (238)..(238): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtgggatgttgtgttgactcagtctccactcctccctgcccgtcacccttggacagccgcctccatctcctgcaggtcaagtcagagcctcgtnacgataagtgggaacacctactgagttggttcagcagacggccaggaccatcctccaaggcgtaccttaatttagtaaggtttctaggcggactcgtcggggtccagaccagtattcgaggcggacagggtgggtcagggcgctggtactttcgaactacgtagaagtaactacgagacgggtaggggtgggaggacgtaggaaacgtgttagggttacggggtttattaacgtggtactagtcggagtagggtacgtaggtcggtcgtcccgttcgcgttcgacttcggtcgggacgggtaacgggtacgaagggttcgagtaagtacgaaacgtacgtggttcggcgttcgaaccg

SEQ ID NO: 312181 - DNA, 735 bp, Homo sapiens
  misc_feature: GZ8MTXP01ESAKH.11.28.C06.1.454.CMB.2.raw
  modified_base (202)..(202): a, c, t, g, unknown or other
  misc_feature (202)..(202): n is a, c, g, or t
  modified_base (504)..(504): a, c, t, g, unknown or other
  misc_feature (504)..(504): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctcgcccgtcacccttggacncgcccggcctccatcctccgtgcaggtcaagtcagacgtcccttagtcaacgtaataagtacgggaaacctaccttacgttggtaggtttgttacagacgaggaggcccgaggacccaaagtccgtaccgaaaggtccgtaacctttaaaagttttaacgttaagggtttccgtaaggggtccgggtaacgttcggtcgggggtaccccaaggaaccctaggtacttcggacggccggaacgtaagggtggggtacgacgggtccgtcgttagtactttacgaactacgtagaaacgtaacncggaggacggtaagggggttacggaagggtacgtaaggtaaaggtaggtttacggggtttaaccggggttttaattaccggtagtaccgtaggttacggaacggtaagggttacgtaggtcgttaccgtaccgtttcgcgtcgtcgttacgggtccgggagggtacgggaaccgttaaaggggttcgaaggtaacgtaacgaaaccgtgtacgggttacgcgttcgaaccg

SEQ ID NO: 312182 - DNA, 632 bp, Homo sapiens
  misc_feature: GZ8MTXP01E4WUU.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcaccctggacagccgctccatctctgcaggtcaagtcagacgcccttcgttacaacgaataagtcgggaaactaccttagttgagtttggttcagcaggacggccaggaccaatcctaccgaaggccgtaccttaaatttaagtaacggtttcgagggccgggtactcggtcggggtacccagaccagtatcgaggcggaacagggtgggtcagggcgtcgtgtatttcaactactagaagaatcgaggcggaggggtggagcgtagaagtagttagggttacggggtttaattacgtgacctagtacggacggtaagggtacgaggttcggtcggtaccctcgtccgtcggacgttagggttccgggacggggtaacggggaaccgaaggggttcggaacgtaacgtaacgaaaacggtcgtagggttacgtcgttcgaaccc

SEQ ID NO: 312183 - DNA, 523 bp, Homo sapiens
  misc_feature: GZ8MTXP01CG94U.11.28.C06.1.454.CMB.2.raw
  modified_base (396)..(396): a, c, t, g, unknown or other
  misc_feature (396)..(396): n is a, c, g, or t
  modified_base (456)..(456): a, c, t, g, unknown or other
  misc_feature (456)..(456): n is a, c, g, or t
  modified_base (473)..(473): a, c, t, g, unknown or other
  misc_feature (473)..(473): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacagccgcctcatctcctgcaggtcaagtcagagccttgtcacgataatggaacacctactgagttgttcagcagagccaggccaatctccaaggcgactaatttataaggtttctaggcgggtactcgtcggggtcccagaccagattcgagcggcaggtgggtcagggcgtctagactttcacactgaagaatcagngaggggtggaggctagaagtagtggttacggggtttatacgtggtcaagtgcgaggtacnggtgtgtccttgctcgnttagtcggcggagggccaaggttgagaatacaaagctgagccgttgaacc

SEQ ID NO: 312184 - DNA, 499 bp, Homo sapiens
  misc_feature: GZ8MTXP02F8DRU.11.28.C06.1.454.CMB.2.raw
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagaccagattcagcggcagtgggtcaggcgctgatttcacactgagaatcagcagggtgaggctgagatgtcgggtttatactgcatgcagggtacagtgtggccttcgctcgcattcggcggagggaccaaggtgagaagtcaaacgactgtgctgacc

SEQ ID NO: 312185 - DNA, 525 bp, Homo sapiens
  misc_feature: GZ8MTXP02HH3JW.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctacttgagttggttcagcagaggccaggccaatctccaaggcacctaatttataaggtttctagggcggactcgtggggtcccagaccagattcagcgcagtgggtcaggcgctgatttcacactgagaatcgagcgagggtggaggctagaagagtggtcggggtttatacgtgcagtgcgagggtacagtgtcgcctgctcgctagttcggcggacggaccgaagggtggaagaacgtacgaaaacggtactggtacggctacgacc

SEQ ID NO: 312186 - DNA, 502 bp, Homo sapiens
  misc_feature: GZ8MTXP02HM796.11.28.C06.1.454.CMB.2.raw
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (477)..(477): a, c, t, g, unknown or other
  misc_feature (477)..(477): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaaggcgcctaaatttataaaggtttctaggcgggactctggggtcccagaccagattcagcggcagtggggtcaggcgctgatttcacactgagaatcagcagggtggaggctgaagatggtcggggtttattactgcatgcagggtangtgngctcgctcgcagtcggcggacggacgaggngagaagacgaaacgacngngcgngc

SEQ ID NO: 312187 - DNA, 515 bp, Homo sapiens
  misc_feature: GZ8MTXP02F232I.11.28.C06.1.454.CMB.2.raw
  modified_base (445)..(445): a, c, t, g, unknown or other
  misc_feature (445)..(445): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaaattttataaaggtttctaggcggggactctggggtcccagacagattcagcggcagtgggtcaggcgctgatttcacactgagaatcagcaggtggaggctgaagatgtcggggttattactgcatgcagggtacagtgnggccttcgctcggcagttcggcggagggaccgaaagggtggagaagtacgaaaacgaactgtggctgacc

SEQ ID NO: 312188 - DNA, 507 bp, Homo sapiens
  misc_feature: GZ8MTXP02GZEOQ.11.28.C06.1.454.CMB.2.raw
  modified_base (407)..(407): a, c, t, g, unknown or other
  misc_feature (407)..(407): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcggactctggggtcccagaccagattcagcggcagtgggtcaggcgctgatttcacactgagaatcagcagggtggaggctgaagntgtcggggttattacgtgcatgcagggtacagtgtgccttgctcgcagttcggcggacgggaccaaggtggagaagtcaaaacgaactgacggctggacc

SEQ ID NO: 312189 - DNA, 509 bp, Homo sapiens
  misc_feature: GZ8MTXP02GBAKX.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcgggactctggggtcccagaccagattcagcgcagtgggtcaggcgctgatttcacactgagatcagcagggtgaggctgagatgtcggggtttatacgtgcatgcgagggtacagtgtggccttcgctcgcagttcggcggacgggaccgaaggtggaagaagtacgaaacgaactgtggctgacc

SEQ ID NO: 312190 - DNA, 517 bp, Homo sapiens
  misc_feature: GZ8MTXP02IKYLQ.11.28.C06.1.454.CMB.2.raw
  modified_base (507)..(507): a, c, t, g, unknown or other
  misc_feature (507)..(507): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagagccaggccaatctcaaggcgacctaatttataaggtttcaggcggactcgtggggtccagaccagatcagcgcagtgggtcagcgctgatttcacactgagaatcagcagggtggaggctagaagagttggttacggggtttaattacgttgcagtgacgagggtacaggtgtggtccttcgctcgctagttcggcggacggaccaagggtgagaagtacaaaacgacngtcgctgacc

SEQ ID NO: 312191 - DNA, 515 bp, Homo sapiens
  misc_feature: GZ8MTXP02HKEIV.11.28.C06.1.454.CMB.2.raw
  modified_base (407)..(407): a, c, t, g, unknown or other
  misc_feature (407)..(407): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctactgagttggttcagcagaggccaggccaatctccaaggcgcctaatttataaggtttctaggaggactctggggtcccagaccagattcagcgcagtgggtcaggcgctgatttcacactgagaatcagcgagggtggaggctgaagngtggtcggggtttattacgtgcatgcagggtacagtgtggcttcgctcgcagttcggcggagggaccaagggtggagaagtacgaaacgacgtggtacggcgtagccg

SEQ ID NO: 312192 - DNA, 513 bp, Homo sapiens
  misc_feature: GZ8MTXP02HGHDQ.11.28.C06.1.454.CMB.2.raw
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctattgagttggttcagcagagccaggccaatctccaaaggcgacctaaatttataaaggtttctaaggcgggactcgtggggtcccagaccagattcagcgcaggtgggtcaggcgctgatttcacactgagaatcagcaggggtgaggctagaagtatggttacgggtttattacgtgcatgcaggtacaggtgtgccttgctcgctagtcggcggaaggaccaaggtgaagaagtacaaaacgactagcggctagc

SEQ ID NO: 312193 - DNA, 527 bp, Homo sapiens
  misc_feature: GZ8MTXP02HY88X.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctactgagttggttcagcagagccaggccaatctcaaggcgcctaatttataaggtttctaggcgggactcgtggggtcccagaccagattcagcggcagtgggtcaggcgctgatttcacactgagaatcagcgagggtgaggctgaagagtggttcggggtttaatacgttagcagtgcgtaggggtacaggtgtggccttcggctcggctagttcggcggtagggaccgaaggtcggagaagtcgaaaacgactggacggctaggacc

SEQ ID NO: 312194 - DNA, 560 bp, Homo sapiens
  misc_feature: GZ8MTXP02HX11Q.11.28.C06.1.454.CMB.2.raw
  modified_base (492)..(492): a, c, t, g, unknown or other
  misc_feature (492)..(492): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgccttcgttcacgtaataaagtgggaaaccacctactgagttggttcagcagaggccaggccaatctccaaggcgacctaaatttataaggtttcagggcggactcgtggggtcccagaccagattcagcggcagtgggtcaggctcgtagtactttccgacacgtgaagaatcgaagcgtaaggggtggaggcgtaggaagtagttggttacggggttttattacgtgcagtgagagggtacagtgcgtccttgctcgntacgtcggacggacgggtaccgaagggtcgagaacgtacgaaaacgtacgtggtacgcgttacgaccg

SEQ ID NO: 312195 - DNA, 509 bp, Homo sapiens
  misc_feature: GZ8MTXP02FWVXT.11.28.C06.1.454.CMB.2.raw
  modified_base (356)..(356): a, c, t, g, unknown or other
  misc_feature (356)..(356): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcgggactctgaggtcccagacagattcagcggcngtgggtcagggcgctgatttcacactgagaaatcaagcagggtgaggctgaagatgtcggggtttatacgtgcatgcagggtacagtgtggccttcgctcgcagttcggcggaggaccgaaggtggaagagtacgaaaacgactgtggactcg

SEQ ID NO: 312196 - DNA, 525 bp, Homo sapiens
  misc_feature: GZ8MTXP02GO48Q.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcggactcgtggggtcccagaccagattcagcggcagtggggtcaggcgctgatttcacactgagatcagcgagggtggagctgaagatggtcggggtttatacgtgcatgcgagggtacaggtgtggccttcgctcgctagttcgggacggtacgggaccaagggtggagaagtacgaaaacggtactggtcggactcggacc

SEQ ID NO: 312197 - DNA, 542 bp, Homo sapiens
  misc_feature: GZ8MTXP02J068W.11.28.C06.1.454.CMB.2.raw
  modified_base (519)..(519): a, c, t, g, unknown or other
  misc_feature (519)..(519): n is a, c, g, or t
tcagcgagagataccacgaccggtgctcgatttagagctcacgtattgggtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgccaggctccagggcaggggctggaatggatttcatacattggtgaaagtggcagtcccatataccacgcagactctgtgaagggccggttcaccatctccagggacaactccaaaactcactatatctggaaatgactagcctgagctcgaggacacggccgtttattactgtgcgacgcccgccgatagcagcatcatctactggggccagggggaccctgggtccaccgtctcctctgcctccaccaacgggccccacgtccgggtccttcccccgtggccgccccgtcgcctccgaaggacnccgaccctcccgagacgcaaccg

SEQ ID NO: 312198 - DNA, 521 bp, Homo sapiens
  misc_feature: GZ8MTXP02G3OWL.11.28.C06.1.454.CMB.2.raw
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctacttgagttggttcagcagagccaggccaatctccaaggcgacctaatttataaggtttctaggcgggactcgtggggtcccagaccagattcagcggcagtgggtcaggcgctgatttcacactgagaatcagcagggtggaggctagaagatggtcggggtttattacgtgcagtgcgagggtacagtgtggccttcgctcgcagttcggcggacgggaccgaaggtggagaagtacgaaaacgactggtacggcgtcgaccg

SEQ ID NO: 312199 - DNA, 527 bp, Homo sapiens
  misc_feature: GZ8MTXP02FVN4L.11.28.C06.1.454.CMB.2.raw
  modified_base (411)..(411): a, c, t, g, unknown or other
  misc_feature (411)..(411): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcgggactcgtggggtcccagaccagattcagcggcaggtgggtcaggcgctgatttcacactgagaatcagcgagggtgaggctgaagngttggttcggggtttattacgtgcagtgacgagggtacagtgtggccttcgctcgctagttcgggcggtaacgggaccgaagggtggagaactacgaaaacgacgtgtggctgacc

SEQ ID NO: 312200 - DNA, 512 bp, Homo sapiens
  misc_feature: GZ8MTXP02I4L1O.11.28.C06.1.454.CMB.2.raw
  modified_base (371)..(371): a, c, t, g, unknown or other
  misc_feature (371)..(371): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgacctaatttataaggtttctaggcgggactcgtggggtcccagaccagatcagcggcagtgggtcaggcgntgatttcacactgagaatcagcgagggtgaggctgagagtggtcggggtttatacgtgcatgcgagggtacagtgtggccttgctcgcagttcggcggacggaccaaggtggagaagtacgaaacgactggtcggctgacc

SEQ ID NO: 312201 - DNA, 521 bp, Homo sapiens
  misc_feature: GZ8MTXP02HW0T4.11.28.C06.1.454.CMB.2.raw
  modified_base (406)..(406): a, c, t, g, unknown or other
  misc_feature (406)..(406): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctcaaggcgcctaatttataaggtttctaggcggactcgtggggtccagaccagattcagcggcagtggggtcaggcgctgatttcacactgagaatcagcagggtggagctgagntggtcggggtttattacgtgctatgcgagggtacaggtgtggcctttcgctcgctagttcgggcggtagggaccaaagggtgaagaagtacaaaacggactggtacggctggacc

SEQ ID NO: 312202 - DNA, 522 bp, Homo sapiens
  misc_feature: GZ8MTXP02ITYUE.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaggcgcctaatttataaggtttctaggcggactctggggtccagaccagattcagcggcagtggggtcaggcgctgatttcgacactgagaatcagcgagggtggagctagagatggtacggggtttatactgcagtgcgagggtacagtgtggtccttcgctcgcagttcgggcggacgggaccgaaagggtggagaagtacgaaaacggactggtacggctgacc

SEQ ID NO: 312203 - DNA, 525 bp, Homo sapiens
  misc_feature: GZ8MTXP02JMQEN.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctacttgagttggttcagcagaggccaggccaatctccaaggcgcctaatttataaggtttctaggcggactcgtggggtcccagaccagattcagcggcagtgggtcaggcgctgatttcacactgagaatcagcgagggtggaggctgaagatggtacggggtttatacgtgcagtgcgagggtacaggtgtggccttcgctcgctagttcgggcgggagggaccgaagggtggaagaacgtacgaaaacgacgtggtacggctgacc

SEQ ID NO: 312204 - DNA, 377 bp, Homo sapiens
  misc_feature: GZ8MTXP02H0L5V.11.28.C06.1.454.CMB.2.raw
  modified_base (376)..(377): a, c, t, g, unknown or other
  misc_feature (376)..(377): n is a, c, g, or t
tcagcgagagataccacgaccggtgctcgatttagagctcacgtattgggtttggggaagcagtcccatataccacgcagactctgtgaagggccggttcaccatctccagggacaactccaaaactcactatatctggaaatgactagcctgagactcgaggacacggccgtttattactgtgcgacgcccgccgatagcagcatcatctactggggccaggggaccctggtcaccgtctctctgcctcaccaaggcccatcggtctcccctggcgccctgctccaggagcacctccgagagcacagcggccctgggctgcctggtcaaggctactccgtatcctctcgctgagcgggctggcaaggcgcatagnn

SEQ ID NO: 312205 - DNA, 517 bp, Homo sapiens
  misc_feature: GZ8MTXP02F8L4I.11.28.C06.1.454.CMB.2.raw
  modified_base (410)..(410): a, c, t, g, unknown or other
  misc_feature (410)..(410): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagcccggcctccatctcctgcaggtcaagtcagagcctcgttcacgataatgggaacacctacttgagttggttcagcagaggccaggccaatctccaaggcgcctaatttataaggtttctaggcgggactcgtggggtcccagaccagattcagcgcagtgggtcaggcgctgatttcacactgagaatcagcgagggtgaggctgaagntggtcggggtttatactgcagtgcagggtacagtgtggcttcgctcgcagttcggcggacggaccgaaggtggaagaagtacgaaaacgactggtcggctaggaccg

SEQ ID NO: 312206 - DNA, 527 bp, Homo sapiens
  misc_feature: GZ8MTXP02HINLZ.11.28.C06.1.454.CMB.2.raw
  modified_base (387)..(387): a, c, t, g, unknown or other
  misc_feature (387)..(387): n is a, c, g, or t
  modified_base (445)..(445): a, c, t, g, unknown or other
  misc_feature (445)..(445): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgctaatttataaggtttctaggcgggactcgtggggtcccagacccagattcgagcggcaggtgggtcaggcgctgatttcacactganaatcagcgaggtgagcgtagagagttggtcggggtttatacgtgcagtgcgaggtacngtgtggccttcgcgttcgcgtagttcgggacggacgggacgacggtggaagaagtacgaaaccggtacgtggcggcctgacc

SEQ ID NO: 312207 - DNA, 521 bp, Homo sapiens
  misc_feature: GZ8MTXP02JWD31.11.28.C06.1.454.CMB.2.raw
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcgggactctggggtcccagaccagattcagcggcagtgggtcaggcgctgatttcacactgagaatcagcagggtgaggctgaagagtgtcggggtttattacgtgcatgcgagggtacagtgtggccttcgcttcggcagttcggcggagggaccgaagggtggagaagtacgaaaacggactaggtggccgtggaccg

SEQ ID NO: 312208 - DNA, 510 bp, Homo sapiens
  misc_feature: GZ8MTXP02HNBCO.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcgggactctggggtcccagaccagattcagcggcagtgggtcaggcgctgatttcacactgagaatcagcagggtggagctgagatgtcggggtttatacttgcatgcagggtacagtgtggccttcgctcgcagttcggcggacgggaccaagggtggagaagtcgaaaacgactgtcggctgaccg

SEQ ID NO: 312209 - DNA, 560 bp, Homo sapiens
  misc_feature: GZ8MTXP02GGR8J.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgacctaatttataaggtttctaggcggactcgtggggtcccagaccagattcagcgcagtggtcaggcgctgatttcacactgagaatcagcgaggggtggaggcgtaggaaagagttaggttacgggggttttaattacgttggctaagttgacgtaggggtactaggtggtcggtccttcgcgtcgtcgtagttcgggacgggtagggacccgtaagggtggagaagtacgaaaacggtacgtggtacggcgtaggacc

SEQ ID NO: 312210 - DNA, 550 bp, Homo sapiens
  misc_feature: GZ8MTXP02HP78K.11.28.C06.1.454.CMB.2.raw
  modified_base (288)..(288): a, c, t, g, unknown or other
  misc_feature (288)..(288): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctcctgcaggtcaagtcagagccttcgttcacgataagtggaaacacctacttgagttggttcagcagagcagcaatcncaagcactaattatagtttcaggcggatcgtgggccagaccagatcagcggcaggtgggtcaggcgctgactttcacactgaagaatcgagcgaggggtggaggctaggaagtagttgggttacgggtttattacgtgctagtgacgtaggggtacaggtggtcggtccgttcgcgttcggacgtacggttcgggacggggaacgggaccgaaggggtggaagaacgtaacgaaaacggtacgtggtacggactacggaccg

SEQ ID NO: 312211 - DNA, 553 bp, Homo sapiens
  misc_feature: GZ8MTXP02HJU4D.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataatggaacacctacttgagttggttcagcagaggccaggccaatctccaaggcaccttaatttataaggtttcaggcggactcgtggggtcccagaccagattcgagcggcaggtggggtcaggcgctgactttcacactagagatcgagcgaggggtggaggctagaagagttgggttcgggttttatacgtgctagtgacgagggtacaggttggtcggtccgttcgcgtcgcgtaggttcgggacgggtacggaccgaagggtggagtaacgtaacgaaacggtacgtggtacggcgtagaccg

SEQ ID NO: 312212 - DNA, 522 bp, Homo sapiens
  misc_feature: GZ8MTXP02GICQG.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcgggactcgtggggtcccagaccagatcagcgcagtgggcaggcgctgatttcacactgagatcagcagggtgaggctgaagatggtcggggtttattacgtgcagtgacgagggtacaggtgtggccttcgctcgctagttcggcggaacggaaccgaaggtggaagaacgtacgaaaacgaacgtgtacggctagacg

SEQ ID NO: 312213 - DNA, 632 bp, Homo sapiens
  misc_feature: GZ8MTXP02IX4O1.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataagtggaacactactgagttgttcagcagagccaggccaatctcaaggcacctaatttataaggtttcaggcggactcgtgggactccgagacagtactcgacggcggacgtaggggttcggacgacggccgtagtacgttacttacaacgtacgtagaagtaactacgagacggtaggggtaggacgtacgtaagaagttaggtttacggggtttaacgggtttaaatcgtacgagtaggtacgtacgggtaagggttaacgtggttcggtcggttcccgtcgtaccgtccgacgttaacgggtccgggaacggggaacgggtaaaccgtagggggtagaacgtaaacgtaaacggaaaaccggtaagtcggtacggtactaaccgg

SEQ ID NO: 312214 - DNA, 536 bp, Homo sapiens
  misc_feature: GZ8MTXP02GORU4.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgacctaatttataaggtttctaggcggactcgtggggtcccagaccagatcagcgcagtgggtcaggcgctgatttcacactgagaatcagcgagggtggaggctagaagagttggttacggggtttattacgtgcagtgacgagggtacaggtgtggtcctttcgctcgcgtagttcgggacgggacgggaccgaagggtcggagaacgtacgaaaacgacgtgtacggctgaccg

SEQ ID NO: 312215 - DNA, 608 bp, Homo sapiens
  misc_feature: GZ8MTXP02I9593.11.28.C06.1.454.CMB.2.raw
  modified_base (200)..(200): a, c, t, g, unknown or other
  misc_feature (200)..(200): n is a, c, g, or t
  modified_base (591)..(591): a, c, t, g, unknown or other
  misc_feature (591)..(591): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacngccgcctccatctcctgcaggtcaagtcagacgcctcgtcacgataagtggaacctacctactgtagttggttcagcaggacggccaggccaatctaccgaaggccgtaccttaaatttagtaaggtttcgagggcggtactcgtcggggtacccaggacccagtacttcgaggcggacgtagggtcggggtcagggtcgtacgtgtactttcactacgtagaagaatcgagcggtaaggggtggaaggtcgtaaggaagtagttgggttacggggtttatacgtgactagtgacgtagggtacaggttgtcggtccttcgcgttcggcgttacggtccggggacgggaacgggtaccgaaggggtcggaagaacgtaacgaaacgtacgnggtcggacgtacgaccg

SEQ ID NO: 312216 - DNA, 527 bp, Homo sapiens
  misc_feature: GZ8MTXP02IA2EH.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacactactgagttggttcagcagaggccaggccaatctcaaggcgacctaatttataaggtttcaggcggactcgtggggtcccagaccagattcaggcggcaggtggggtcaggcgctgactttcacactgagaatcagcgagggtggaggctagagagtggttcggggtttatacgtgcagtgcgagggtacaggtggtggccttcggcttcggctagttcggacgggacgggaccaaggggtgagaagtacaaaacgactggtcggctcgacc

SEQ ID NO: 312217 - DNA, 541 bp, Homo sapiens
  misc_feature: GZ8MTXP02GKZ40.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtgggaacacctacttgagttggttcagcagagccaggccaatctcaaggcgacctaatttataaggtttcaggcggtactcgtggggtcccagaccagattcgagcggcagtgggcaggcgctgtactttcacactgaagatcgagcgagggtggaggcgtagaagtagtggttacggggtttattacgtgactagtgacgaggtacgagtggtgtccgtcgcgtcgcgtagttcgggacgggacggaccgaaggtggagaagtacgaaacgtacgtggtcggcgtacgaccg

SEQ ID NO: 312218 - DNA, 549 bp, Homo sapiens
  misc_feature: GZ8MTXP02HGT2U.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtggaacacctacttgagttggttcagcagaggccaggccaatctaccgaaggcgacctaatttagtaaggtttcaggcggactcgtggggtccagaccagatcgagcggcaggtgggtcaggcgctgatttcacactgaagaatcgagcgagggtggaggctagaagtagttggtacgggtttatacgtgactagtgacgtagggtacaggtggtcggtccttcgcgtcgctaggtcgggacggaacgggaccgaagggtggaagaagtaacgaaaacgtacgtaggtacggctacgaccg

SEQ ID NO: 312219 - DNA, 669 bp, Homo sapiens
  misc_feature: GZ8MTXP02J29JZ.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatcctcctgcaggtcaagtcagacgccttcgttacacgaataagtggaacctaccttacttgagtttggttacagcgaggacggccaggaccaatccgtaccgaaggccgtaccttaaatttagtaacggtttcgagggcggtactcggtcgggtaccagaccagtacttcgacgtcggacgagggttgggcacggcgtcgtgtactttacacacgtagaagtaatcgaggcgtagggggtagaggtctaagggaagtacgttaggggtttacggggtttaatacggtgactaggtacggtacgtaagggggttaactaggttcgggtccggtccgttccgtccgttacggtacgtacgggttaccgggggaacgggaaccggggtaaccggtaaggggtaacggaaacgtaaccgtaaaccggtaaaccggtacggttcgggtacgtaccgtacgacccg

SEQ ID NO: 312220 - DNA, 525 bp, Homo sapiens
  misc_feature: GZ8MTXP02F1UDR.11.28.C06.1.454.CMB.2.raw
  modified_base (443)..(443): a, c, t, g, unknown or other
  misc_feature (443)..(443): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagccctgttcacgataatgggaacacctacttgagttggttcagcagaggccaggccaaatctccaaggcgacctaatttataaggtttctaggcgggactctggggtcccagaccagattcagcggcagtgggtcaggcgctgatttcacactgagaatcagcagggtggaggctgaagatggtcggggtttattactgcatgcgagggtacngtgtgccgttcgctcgcgagttcggacggacgggaccgaaagggtggaagaagtacgaaaacgaactggtacggacgtgacc

SEQ ID NO: 312221 - DNA, 584 bp, Homo sapiens
  misc_feature: GZ8MTXP02JZP29.11.28.C06.1.454.CMB.2.raw
  modified_base (463)..(463): a, c, t, g, unknown or other
  misc_feature (463)..(463): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtgggaacacctacttgagttggttcagcagaggccaggccaatctaccgaaggcgaccttaaatttataaggtttctaggcggactcgtggggtcccagaccagattcaggcggcaggtggggtcaggggcgcgtgtactttaccacgtacttgaagaaatcgaaggcgagggggtgggaggcgtaggaagagttgggttacggggtttattacgngactagtgacgtaggggtacaggttgtcggtcccgttcgcgttcgctaggttccgggacgggacgggaccgaaagggtggaagaacgtaacgaaaacggtacgtaggtcggtcgtcgaccg

SEQ ID NO: 312222 - DNA, 531 bp, Homo sapiens
  misc_feature: GZ8MTXP02H5FIP.11.28.C06.1.454.CMB.2.raw
  modified_base (285)..(285): a, c, t, g, unknown or other
  misc_feature (285)..(285): n is a, c, g, or t
  modified_base (449)..(449): a, c, t, g, unknown or other
  misc_feature (449)..(449): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtggaacacctactgagttgttcagcagagcagcaatcncagcgactaatttataggtttcaggcggatcgtggggtccagaccagatcagcggcaggtgggtcaggcgctgatttcacactgaagaatcgaagcgaggggtggaggctaggaagtagtagggtttacgggggtttaattacgttgacagtgtcgaggtacgnggtgtcgggccttcggctcgcgtagttcggacggacgggtaccgagggtgagaagtacgaaaacgacgtgtagcgtagaccg

SEQ ID NO: 312223 - DNA, 566 bp, Homo sapiens
  misc_feature: GZ8MTXP02J2J0U.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtggaacacctacttgagttggttcagcagaggccaggccaatctaccgaacggcgaccttaaatttagtaaggtttctaggcggactcgtggggtcccagaccagtattcagcggcaggtgggtcaggcgctgatttcgacactgaagaatcgaagcgaggggtggaggcgtaggaagtagttgggttacggggtttattacgtgtcagtgacgagggtacaggtcgtggtccgttcgcgttcgcgtagtccggggacggaacggggaccgaagggtaggaagtaagtaacgaaaccgacgtggtacggctcggaacc

SEQ ID NO: 312224 - DNA, 633 bp, Homo sapiens
  misc_feature: GZ8MTXP02IC41R.11.28.C06.1.454.CMB.2.raw
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
tcagcgagagataccacgaccggtgctcgatttagagctcacgtattgggtttggggctgatcaggactcctcagttcaccttctcacaatgaggctccctgctcagctcctggggctgataatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatcncaaggcncctaatttataaggtttctaggcggactcgtcggggtcccagacccagattcgaaggcgagtagggtcgacggcggccgtcgtagttacgtacactagtagaaagtacacgacggacgggtaggggagggacggtagaaaggtagtaggttacggggtttacgggttttaatacggtcgtagtaggtacgacgggtaggtacggttagggtcggtccggttcccgtcgtccgttccgacgtttcgggccggggaacggggaacccgggaacgggtaagggtacggaaggtaacgaaaaccggaaaacgtacgtcgggtacggcgtacgaacccg

SEQ ID NO: 312225 - DNA, 521 bp, Homo sapiens
  misc_feature: GZ8MTXP02HLDPD.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcggactcgtggggtcccagaccagattcagcggcagtgggtcaggcgctgatttcacactgagaatcagcagggtgaggctgaagatgtcggggtttatactgcatgcgaggtacagtgtggccttgcttcgctagttcggcgggtacgggaccgaagggtggagaagtacgaaaacggactggtacggcgtacgaccg

SEQ ID NO: 312226 - DNA, 600 bp, Homo sapiens
  misc_feature: GZ8MTXP02ISGJ2.11.28.C06.1.454.CMB.2.raw
  modified_base (506)..(506): a, c, t, g, unknown or other
  misc_feature (506)..(506): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctcgcccgtcacccttggacagccggcctcatctcctgcaggtcaagtcagacgccttcgttcaacgaataagtgggaaacacctattgtagttggttcagcaggacggccaggccaatcctaccgaaaggccgtaccttaaagttttaattaacggttttcgtagggcgggtacttcgtcggggtacccaggacccagtacttcgagcggacaggtcggggtcagggcgctggtatttcgactacgtagaagtaactcgagacgaggggtggaggcgtagaagagttggttacggggttttatacgtgacagtgacgtagggtanaggttcggtgtccgttcgcgttcgctaggttcggacgggaacgggtaccgaaagggtggagaagtacgaaaacggtactggtacggcgtagacc

SEQ ID NO: 312227 - DNA, 530 bp, Homo sapiens
  misc_feature: GZ8MTXP02FW7DX.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcgggactctggggtcccagaccagattcagcggcagtggggtcaggcgctgatttcacactgagaatcagcgagggtggaggctgaagatggtcggggtttattacgtgcatgcaggggtacaggtgtggccttcgcttcgcgtattcgggcggacgggaccgaagggtggaagaagtacgaaaacgaacgtggtacggcgtagaccg

SEQ ID NO: 312228 - DNA, 513 bp, Homo sapiens
  misc_feature: GZ8MTXP02JPCAN.11.28.C06.1.454.CMB.2.raw
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtgggatgttgtgttgactcagtctccactctccctgcccgtcacccttggacagccggcctccatctcctgcaggtcaagtcagagcctcgttcacgataatggaacacctactgagttgttcagcagaggccaggccaatctccaaggcgcctaaatttataaggtttctaggcggactcgtggggtcccagaccagattcagcgcagtgggtcaggcgctgatttcacactgagaatcagcgaggtggaggctgaagatggtcggggtttatacgtgcatgcagggtacagtgtggccttgcttcgcagttcggacggaggaccgaaaggtggagaagtacgaaaacgaacgtgtaggcgtagaccg

SEQ ID NO: 312229 - DNA, 549 bp, Homo sapiens
  misc_feature: GZ8MTXP02HJF0X.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaaatttataaggtttctaggcggactcgtggggtcccagaccagattcgagcggcaggtggggtcaggcgctgtatttcacactgaagaatcgagcgaggggtggaggcgtagaagagttggtacggggtttattacgttgctagtcgcgagggtacagtgtcggtccgttcgctcgcagttcgggcggtacgggaccgagggtcggaagaagtacgaaaacggacgtggtacggacgtcggaccg

SEQ ID NO: 312230 - DNA, 533 bp, Homo sapiens
  misc_feature: GZ8MTXP02H79EG.11.28.C06.1.454.CMB.2.raw
  modified_base (247)..(247): a, c, t, g, unknown or other
  misc_feature (247)..(247): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataanggaacacctatgagttggttcagcagaggccaggccaatcctcaaggcacctaatttataaggtttcaggcggactcgtggggtcccagaccagtattcgagcggacagggtgggtcgaggcgctgtactttcacactagagaatcgagcgagggtggagctagaagtgtggttacgggtttatacgtgcagtgagagggtacaggtgtggtccttcgctcgctagtcggacgggacggaccgaaggtggagaacgtacgaaaacgtacgtggtcggactcggacc

SEQ ID NO: 312231 - DNA, 538 bp, Homo sapiens
  misc_feature: GZ8MTXP02FQSFA.11.28.C06.1.454.CMB.2.raw
  modified_base (299)..(299): a, c, t, g, unknown or other
  misc_feature (299)..(299): n is a, c, g, or t
  modified_base (471)..(471): a, c, t, g, unknown or other
  misc_feature (471)..(471): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataatgggaacacctacttgagttggttcagcagaggccaggccaatctccaaggcncctaatttataaggtttcaggcgggactcgtggggtcccagaccagattcagcggcaggtggggtcagggcgctgatttcacactgagaatcagcgaggggtggaggctagaagatgggttcggggtttattacgtgacagtgcgagggtacaggtggtggccttcgctcgntacgttcggacgggacggaccgaagggtggaagaacgtacgaaaacggtactggtacggctaggacc

SEQ ID NO: 312232 - DNA, 553 bp, Homo sapiens
  misc_feature: GZ8MTXP02GV41S.11.28.C06.1.454.CMB.2.raw
  modified_base (458)..(458): a, c, t, g, unknown or other
  misc_feature (458)..(458): n is a, c, g, or t
  modified_base (478)..(478): a, c, t, g, unknown or other
  misc_feature (478)..(478): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataatggaacacctacttgagttggttcagcagaggccaggccaatctaccaaggcacttaatttataaggtttcaggcggactcgtcggggtcccagaccagattcgagcgcaggtgggtcaggcgctgtactttcgacactgaagaatcgaagcgaggggtggagcgtagaagagttggttacgggtttatacgtgctagtgacgtagggtacnggtgtcgtccgttcgctcgntacggttcgggacggtaacggggaccgaagggtggaagtaacgtacgaaaacggtacgtggtacggctggaaccc

SEQ ID NO: 312233 - DNA, 547 bp, Homo sapiens
  misc_feature: GZ8MTXP02F8LG1.11.28.C06.1.454.CMB.2.raw
  modified_base (202)..(202): a, c, t, g, unknown or other
  misc_feature (202)..(202): n is a, c, g, or t
  modified_base (498)..(498): a, c, t, g, unknown or other
  misc_feature (498)..(498): n is a, c, g, or t
tcagcgagagataccacgaccggtgctcgatttagagctcacgtattgggtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttangagttggatccgccaggctccgagggcaggggctggaatggatttcatacattggtgaaagtggcagtcccatataccacgcagactctgtgaaggccggttcaccatctcagggacaactaccaaaaactcaactatatctaggaaatgactagcctagagacgtacgaggacacgtccgtttaatactagtgcgacgcccgcgatagcagcatcatctacgtcggggaccgacggggaccctggtccaccgtcctcctctcgcctccacgacggcccacgtccgtccttccccnggccgcccgtcgcctaccgaacggacgccaccgtccgagacgacgaccg

SEQ ID NO: 312234 - DNA, 512 bp, Homo sapiens
  misc_feature: GZ8MTXP02I1RY2.11.28.C06.1.454.CMB.2.raw
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaagcgcctaatttataaggtttctaggcggactctggggtcccagaccagattcagcggcagtgggtcaggcgctgatttcacactgagaatcagcagggtggaggctagagatgtcggggtttattactgcatgcagggtacaggtgtggcttcgctcgcagttcggcggagggaccaaagggtggagaagtcgaaaacgaactggtacggctggacc

SEQ ID NO: 312235 - DNA, 531 bp, Homo sapiens
  misc_feature: GZ8MTXP02J1G52.11.28.C06.1.454.CMB.2.raw
  modified_base (445)..(445): a, c, t, g, unknown or other
  misc_feature (445)..(445): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttcaggcggactcgtggggtcccagaccagatcagcgcagtgggtcaggcgctgatttcgacactgagaatcagcgaggggtgaggtctagaagagtggttcggggtttatacgtgcagtgcagggtacnggtgtcggccttcgctcgcgtagtcgggcggacgggaccgaagggtcggagaacgtaccgaaaacggtactggtacggctaggacc

SEQ ID NO: 312236 - DNA, 600 bp, Homo sapiens
  misc_feature: GZ8MTXP02IPJCA.11.28.C06.1.454.CMB.2.raw
  modified_base (279)..(279): a, c, t, g, unknown or other
  misc_feature (279)..(279): n is a, c, g, or t
  modified_base (372)..(372): a, c, t, g, unknown or other
  misc_feature (372)..(372): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatcctcctgcaggtcaagtcagagcctcgtcacgataagtggaacacctacttgagttggttcagcagngccaggccaatctcgaaggcaccttaatttagtaaggtttcaggcggactcgtggggtcccagaccagatcgagcggcaggtgggtcagggcncgtagtactttcaacactgaagaactcgaaggcgagggggtggaggtctagaagagttgggttacggggtttattacgtgacgtagtacggcggtaagggtacgaggttcggttcggtccgtttcggccgttaccggcgttacgggttccgggacggggtaaacgggaccggtaaaggggtggaacgtaacgtaaccgaaaacggtacgtaggtacggactacgaccg

SEQ ID NO: 312237 - DNA, 522 bp, Homo sapiens
  misc_feature: GZ8MTXP02FZAYK.11.28.C06.1.454.CMB.2.raw
  modified_base (408)..(408): a, c, t, g, unknown or other
  misc_feature (408)..(408): n is a, c, g, or t
  modified_base (449)..(449): a, c, t, g, unknown or other
  misc_feature (449)..(449): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttcaggcggactcgtggggtcccagaccagatcagcggcaggtgggtcaggcgctgatttcacactgagatcagcgagggtggagctagaagntggttacggggtttattacgtgcagtgcgagggtacagtgngtccgtgctcgcagttcgggacggagggaccgaaggtggaagaagtacgaaaacgtactggtacggctcgacc

SEQ ID NO: 312238 - DNA, 537 bp, Homo sapiens
  misc_feature: GZ8MTXP02HP4HC.11.28.C06.1.454.CMB.2.raw
  modified_base (485)..(485): a, c, t, g, unknown or other
  misc_feature (485)..(485): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgacctaatttataaggtttctaggcggactcgtggggtcccagaccagatcagcgcagtgggtcaggcgctgatttcacactgagaatcagcgagggtggaggctggaagtagttgggttcggggttttaattacgttgacgatgacgagggtacaggtgtggccgttgcttcgcaggttccgggnggacgggtaccgaagggtggagaagtacgaaaacgactggtcggctcggacc

SEQ ID NO: 312239 - DNA, 529 bp, Homo sapiens
  misc_feature: GZ8MTXP02HRKU4.11.28.C06.1.454.CMB.2.raw
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (516)..(516): a, c, t, g, unknown or other
  misc_feature (516)..(516): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacagccgcctcatctcctgcaggtcaagtcagagcctcgttcacgataatggaacacctactgagttggttcagcagngccagccaatcncaagcactaatttataaggtttcaggcggactgtcggggtccagaccagtattcaggcgcaggtggggtcaggcgctgatttcacactgaagaatcagcgaaggggtgggaggctagaagtagtggtttacggggtttattacgttgctagtgagaggtagaggtgtggtccttcgctcgcgtagttcgggcggacggaccgaaggtggagaagtacgaaaacgtacgngtacggctagacc

SEQ ID NO: 312240 - DNA, 543 bp, Homo sapiens
  misc_feature: GZ8MTXP02JUNH1.11.28.C06.1.454.CMB.2.raw
  modified_base (387)..(387): a, c, t, g, unknown or other
  misc_feature (387)..(387): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtggaacacctactgagttgttcagcagaggcaggccaatctccaaggcacctaatttataaggtttcaggcggactcgtggggtcccagacccagattcgagcggcaggtggggtcaggcgtctgatttcacactgaanaatcagcgagggtggagcgtagagtagtaggttcggggtttaattacgtgactagtgacgtagggtactaggtcgtcggtccgttcgcgttcgctaggtcggggacggtacgggaccgagggtggagaagtacgaaacgtacgtggcggctagacc

SEQ ID NO: 312241 - DNA, 531 bp, Homo sapiens
  misc_feature: GZ8MTXP02F0E6I.11.28.C06.1.454.CMB.2.raw
  modified_base (221)..(221): a, c, t, g, unknown or other
  misc_feature (221)..(221): n is a, c, g, or t
  modified_base (492)..(492): a, c, t, g, unknown or other
  misc_feature (492)..(492): n is a, c, g, or t
tcagcgagagataccacgaccggtgctcgatttagagctcacgtattgggtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgccaggcncctagggcaggggctggaatggatttcatacattggtgaaagtggcagtcccatataccacgcagactctgtgaagggccggttcaccatctcagggacaactccaaaaactcactatatctggaaatgactagcctgagctcgaggacacgccgtttatactgtgcgacgcccgcatagcagcatcatctacgtggggccaggggaccctgggtccaccgtcctcctctcgcctccaccaagggccccatccggtcttcccccgtggccnccctcgcctccgaaggacgccacctcgacgacgcaaccg

SEQ ID NO: 312242 - DNA, 527 bp, Homo sapiens
  misc_feature: GZ8MTXP02HLFT9.11.28.C06.1.454.CMB.2.raw
  modified_base (357)..(357): a, c, t, g, unknown or other
  misc_feature (357)..(357): n is a, c, g, or t
  modified_base (380)..(380): a, c, t, g, unknown or other
  misc_feature (380)..(380): n is a, c, g, or t
  modified_base (420)..(420): a, c, t, g, unknown or other
  misc_feature (420)..(420): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataagtgggaacacctacttgagttggttcagcagacggccaggccaatctaccgaaggccgaccttaaatttagtaaggtttcagggcggtactcgtggggtccagaccagnttcagcgcaggtgggtcaggcgntgatttcacactgagatcgagcgagggtggagctagagtntgggttcgggtttatacgtgctagtgacgagggtacagtggtcggtcttcgctcgctagtcgggcggacggacgaggtgagaatacgaaacgacgtgacgctacgac

SEQ ID NO: 312243 - DNA, 574 bp, Homo sapiens
  misc_feature: GZ8MTXP02HQ2WB.11.28.C06.1.454.CMB.2.raw
  modified_base (292)..(292): a, c, t, g, unknown or other
  misc_feature (292)..(292): n is a, c, g, or t
  modified_base (377)..(377): a, c, t, g, unknown or other
  misc_feature (377)..(377): n is a, c, g, or t
  modified_base (469)..(469): a, c, t, g, unknown or other
  misc_feature (469)..(469): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataatgggaacacctacttgtagttggttcagcagagcaggccaatcnccgaagcgtacctaatttagtaaggtttctaggcggactcgtcggggtccaggaccagattcagcgacgagtcggggtcagggcncgtgtactttcacactagagtaatcgagcgaggggtggaaggcgtaggaagtgtggttacggggtttattacgtgctagtgcgtaagggtanaggtcggttcggtccgttcgccgttcggcgtaggttccgggacggggtaacgggaccgaagggtggaagtaacgtacgaaaacggtacgtggtcggtctcggacc

SEQ ID NO: 312244 - DNA, 538 bp, Homo sapiens
  misc_feature: GZ8MTXP02JDCPL.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctactgagttggttcagcagaggccaggccaatctccaaggcacctaatttataaggtttctaggcggactcgtggggtcccagacagatcagcgcagtgggtcaggcgctgatttcacactgagatcagcgagggtggaggctgaagagtggtacggggtttattacgtgctagtgacgagggtacaggtgtggccttcgctcgacagttcgggacgggacgggaccgtaaaggggtcggaagaagttacgaaaacggtacgtggtcggtcgttacggacc

SEQ ID NO: 312245 - DNA, 601 bp, Homo sapiens
  misc_feature: GZ8MTXP02H51PG.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttgacagcccgcctccatcctcctgcaggtcaagtcagagcctcgttcacgataagtggaacactactgagttggttcagcagaggccaggccaatctccaaaggcgtaccttaatttagtaaggtttcagggcggtactcgtggggtacccagacccagtacttcgaggtcggcgaggtggggtacaggcgcttgactttcacacgtgaagaactcgaggacgtagggggtggaggtacgtaggaaaggttagttggggtttacgggggtttttaattacgttgactaagttggacgtaggggtacaggttggtcggtccttcggccgttcgcgtaggttccgggcggggacgggtaaccgagggtaggaaggaactacgaaaacggtacgtaggtcggctcggaccg

SEQ ID NO: 312246 - DNA, 557 bp, Homo sapiens
  misc_feature: GZ8MTXP02H3HJJ.11.28.C06.1.454.CMB.2.raw
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (385)..(385): a, c, t, g, unknown or other
  misc_feature (385)..(385): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttgacagccggcctcatctcctgcaggtcaagtcagcgctcgtcagataanggaacactntgagttgttcagcagagcagcaatcncagcactaattatagtttnaggcggatcgtcgggccagaccagtatcaggcggcagggtgggtcaggcgctagtattcacactgaagatcgagcgaagggtggacgntaggagtagtgggttacggggtttatacgtgagtagtggaggtaagggtactaggtcggttcggtcctttcgcgttcggacgtacggttccggggaacgggggaacgggaaccgaaaggggtcggaaaggtaacgtaacgaaaaacgtacgtaggtcggacctaggaacccg

SEQ ID NO: 312247 - DNA, 533 bp, Homo sapiens
  misc_feature: GZ8MTXP02FUR8X.11.28.C06.1.454.CMB.2.raw
  modified_base (408)..(408): a, c, t, g, unknown or other
  misc_feature (408)..(408): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcgggactcgtggggtcccagaccagattcagcgcagtgggtcaggcgctgatttcacactgagaatcagcagggtgaggctgaagntggtcggggtttattacgtgcagtgcgagggtacagtgtggccttcgctcggcagttcgggcgggacgggacccgaaaaggggtcggaagaagtacgaaaacggtaacgtaggtgggctcggacc

SEQ ID NO: 312248 - DNA, 539 bp, Homo sapiens
  misc_feature: GZ8MTXP02HVF15.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatcctcctgcaggtcaagtcagagcctcgttcacgataatgggaacacctactgagttggttcagcagaggccaggccaatctccaaggcgacctaaatttataaggtttctaggcgggactcgtggggtcccagccagattcagcgcagtgggtcaggcgctgatttcactactgagaatcagcgaggggtggaggctagaagatggttacggggtttattacgtgcagtgacgagggtacaggtgtcggccttcgctcgctagttcgggacggtaagggaccgaagggtggagaagtacgaaaacggtaacgtgtacggctacggacc

SEQ ID NO: 312249 - DNA, 504 bp, Homo sapiens
  misc_feature: GZ8MTXP02JW9QF.11.28.C06.1.454.CMB.2.raw
  modified_base (442)..(442): a, c, t, g, unknown or other
  misc_feature (442)..(442): n is a, c, g, or t
  modified_base (501)..(501): a, c, t, g, unknown or other
  misc_feature (501)..(501): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcggactcgtggggtcccagaccagattcagcggcagtgggtcaggcgctgatttcacactgagaatcagcgagggtggaggctagagagtggtcggggtttatacgtgcatgcagggtacngtgtgtcctcgctcgcgtgtcggcggacggacgaggtgagaagacgaaacgactgcgcngcg

SEQ ID NO: 312250 - DNA, 552 bp, Homo sapiens
  misc_feature: GZ8MTXP02IW42C.11.28.C06.1.454.CMB.2.raw
  modified_base (379)..(379): a, c, t, g, unknown or other
  misc_feature (379)..(379): n is a, c, g, or t
  modified_base (404)..(404): a, c, t, g, unknown or other
  misc_feature (404)..(404): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgtcacgataatgggaacacctactgagttggttcagcagaggccaggccaatctccaaggcacctaatttataaggtttcaggcgggtactcgtggggtcccagaccagattcagcggcagtggggtcaggcgctgatttcanactgagaatcagcgagggtggaggngtaccccgaagagtaggttacggggtttaagttacgttgtcgtagtgcgagggtacgtagtggtggtccgttcgcgtcgtctacgttcggacgggacgggaccgaacggtaggaggaagtacgaaacgaaacgtggtggcgtagaccg

SEQ ID NO: 312251 - DNA, 549 bp, Homo sapiens
  misc_feature: GZ8MTXP02JM9RF.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgacctaatttataaggtttctaggcggactcgtggggtcccagaccagatcagcggcagtgggtcaggcgctgatttcacactgagaatcgagcgaggggtggaggcgtagaagagttggttcggggtttaattacgtgacagtgacgagggtacaggtgtcggtccttcgctcggctacggttcgggacggacggggaccgaaggggtggaagaagtaacgaaaacggtacgtaggtcggtactggacc

SEQ ID NO: 312252 - DNA, 546 bp, Homo sapiens
  misc_feature: GZ8MTXP02IB4SK.11.28.C06.1.454.CMB.2.raw
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacactacttgagttggttcagcagagccaggcaatctcaaggcgacctaatttataaggtttcaggcgggactcgtggggtcccagaccagattcagcggcagtgggtcaggcgctgactttcacactgagaatcagcgaggggtggaggctaggagtagtggttcggggtttatacgtgctagtgcgaagggtacaggtgtcggcctttcgctcgctagttcggacgggaacgggtaccgaagggttcggaagtaagtaaccgaaaacggtaacgtggtcggacgtcggaaccg

SEQ ID NO: 312253 - DNA, 627 bp, Homo sapiens
  misc_feature: GZ8MTXP02IBCAE.11.28.C06.1.454.CMB.2.raw
  modified_base (255)..(255): a, c, t, g, unknown or other
  misc_feature (255)..(255): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgccccgtcacccttggacagccggcctccatctcctgcaggtcaagtcagagcctcgttcacgataagtggaacnctacttgagttggttcagcagaggccaggccaatctaccaaggccgtacctaatttaagtaaggtttcaggcggactcgtcggggtcccagaccagtacttcaggcggcaggttgggtcgaggcgcttgtactttcacactgagtaatcgaggcgtaagggggtggaagggtcgtaggaagtagttgggttacggggttttaatacgttgacgtagttcgacgtaagggtacgtaggtcggttcggtccgtttccggcgttccggacgtaacggtttccggggaccgggggtaaacggggtacccgaaaggggttcggaacggtaacgttaaccgaaaacggtaaccgtgggtacggtacttacggaacccg

SEQ ID NO: 312254 - DNA, 516 bp, Homo sapiens
  misc_feature: GZ8MTXP02IA0N5.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcaacgataatggaacacctacttgagttggttcagcagaggccaggccaatctccaaggcgacctaatttataaggtttcaggcggactcgtggggtcccagaccagattcagcggcagtgggtcaggcgctgatttcacactgagaatcagcgaggggtggaggcgtagaagagtggttacggggtttattacgtgcatgcgagggtctagtgtgctcgctcgcagttcggcggacgggaccgaaggtgagaagtacgaaacgacgtgtcgctgac

SEQ ID NO: 312255 - DNA, 576 bp, Homo sapiens
  misc_feature: GZ8MTXP02ITRGI.11.28.C06.1.454.CMB.2.raw
  modified_base (297)..(297): a, c, t, g, unknown or other
  misc_feature (297)..(297): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctattgagttggttcagcagaggccaggccaatctccaaggcncctaatttataaggtttctaggcggactcgtggggtcccagaccagattcagcggcaggtggggtcagggccgctgtactttcacacgtagaagaatcgagtcgaggggtggaggcgtagaagtagttagggttacggggttttaattacgttgctagtagcgtaagggtacaggtggtcggtccgtttcgccgttcgcgtaggttccggggacggggtaacgggaccgaacgggtggaagaagtaaccgaaaacgtacgtggtacggacgtacgaccg

SEQ ID NO: 312256 - DNA, 529 bp, Homo sapiens
  misc_feature: GZ8MTXP02I3ZPK.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctacttgagttggttcagcagaggccaggccaatctccaaggcgacctaatttataaggtttctaggcggtactcgtggggtcccagaccagattcagcggcagtggggtcaggcgctgatttcacactgagaatcagcgagggtggaggctagaagtatggttcggggtttattacgtgcagtgcgagggtacaggtgtggtccttcgctcgcagttcgggacggacgggaccgaaaggtggaagaagtacgaaaacgactggtcggctgacc

SEQ ID NO: 312257 - DNA, 533 bp, Homo sapiens
  misc_feature: GZ8MTXP02GSVZU.11.28.C06.1.454.CMB.2.raw
  modified_base (286)..(286): a, c, t, g, unknown or other
  misc_feature (286)..(286): n is a, c, g, or t
  modified_base (432)..(432): a, c, t, g, unknown or other
  misc_feature (432)..(432): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacactacttgagttggttcagcagagcagcaatcncagcactaatttataggtttcaggcggactcgtggggtccaggaccagatcagcgcaggtgggtcaggcgctgtatttcgacactagaagaatcagtcgaggggtggaaggctaggaaagagttggtacggggtttattacgtganagtgacgtaagggtacaggtgtggtccttcgcgtcgcgtagttcgggcggacggaccgaacgggtgaacgaagtacgaaacgtacgtggcggactcggacc

SEQ ID NO: 312258 - DNA, 593 bp, Homo sapiens
  misc_feature: GZ8MTXP02FVSIJ.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtggaacacctacttgagttggttcagcagaggccaggccaatctccaaggcgaccttaaatttataaggtttctaggcgggtactcgtcggggtcccagaccagatcagcggcaggtgggtcaggcgctgatttcacactgagaatcagcgaggggtggaggctagaaagtgtaggttcggggtttattacgtgctaagtgacgagggtacaggttggtcggccgtttcgccttcggacgttaggttccggggacgggggaacggggaacccggtaaaggggttcgggaaaggaacgttaaccggaaaaacggtaaaccggtggtacgggtaccgtggtaacccg

SEQ ID NO: 312259 - DNA, 575 bp, Homo sapiens
  misc_feature: GZ8MTXP02ISPJI.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataatgggaacacctactgagtttggttcagcagaggccaggccaatctaccgaaggcgtaccttaaatttaataaggttttctagggcggtactcgttcggggtccccagacccagacttcaggtcggcgaggtgggggtcagggccgcttgactttcactacgtgaagaatcgaggcgagggggtggaggtcgtaggagtagtggtttacggggttttatacgtggacagttgacgtagggtacaggttgtcgtccgttcgctcggctaggttcgggacggacggacgaagggtgagaacgtacgaaaacgtacgtggcggacgtgacc

SEQ ID NO: 312260 - DNA, 614 bp, Homo sapiens
  misc_feature: GZ8MTXP02JF73B.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacagccggcctccatctcctgcaggtcaagtcagacgcctcgttcacgataagtggaacactactgtagttgttcagcagacggccaggccaatcctaccgaaggcctaccttaaatttagttaaggtttcgtagggcggtactccgtcggggtcccagaccagtatcgaggcggcagggtggggtcaggcgtctgtactttcactagtgaagatcgagcggaggggtggaggtacgtaggaagtagttgggttcggggtttatacgtgactagtacgtcggtaggggtacaggttcggtcggtcccgttcggcgttacggcgttacgggttccggggaacgggggtaaacggaccggtaaacggggtggaagtaacgtaaccgtaaaaacggtggttaggtcggacgtacgaaccg

SEQ ID NO: 312261 - DNA, 527 bp, Homo sapiens
  misc_feature: GZ8MTXP02IHJTS.11.28.C06.1.454.CMB.2.raw
  modified_base (372)..(372): a, c, t, g, unknown or other
  misc_feature (372)..(372): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaaggcgacctaatttataaggtttcaggcggactcgtggggtcccagaccagattcagcggcagtggggtcagggcncgtgtatttcacactgaagaatcagcgagggtggagcgtgaagagtggttcggggtttattacgtgcagtgcgagggtacagtgtgccgttcgcgtcgcgtagttcggacggacggaccgaagggtgagaagtcgaaaacgactggtcgctgacc

SEQ ID NO: 312262 - DNA, 563 bp, Homo sapiens
  misc_feature: GZ8MTXP02JB32V.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctactgagttggttcagcagaggccaggccaatctccaaggcgacctaatttataaggtttctaggcggactcgtcggggtcccagaccagatcagcggacagtgggtcaggcgctgatttcacacgtgagaatcgagcgaggggtggaaggcgtaggaaaggagttggggttacgggggttttaattacgtagctagtgcgtagggtacaggtgtggccttcgcgtcgactagttccgggacgggaacgggtaccgaaaggggtggaagtaacgtacgaaaacggtactggtcggactacggcccg

SEQ ID NO: 312263 - DNA, 542 bp, Homo sapiens
  misc_feature: GZ8MTXP02HNG3W.11.28.C06.1.454.CMB.2.raw
  modified_base (454)..(454): a, c, t, g, unknown or other
  misc_feature (454)..(454): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataatgggaacacctacttgagttggttcagcagagccaggccaatctccaaggcgactaatttataaggtttctaggcggtactcgtggggtccagaccagattcagcgcaggtgggtcaggcgctgtatttcacactgagatcgagcgagggtggaggctagaaagtgttggttacggggttttaattacgtgcagtgcgagggtacnggttgtggccgttgcgttcgcgtagttcgggcgggtacgggaccaaggggtggagaagtacgaaaacggtacgtgtcggcttacggac

SEQ ID NO: 312264 - DNA, 580 bp, Homo sapiens
  misc_feature: GZ8MTXP02IY9XX.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagcccggcctccatctcctgcaggtcaagtcagacgcctcgttcacgataagtggaacacctattgagttggttcagcagagccagccaatctcaaggcacctaatttagtaaggtttctaggcggtactcgtcggggtcccagaccagtattcgagcggcaggtggggtcagggcgtctgtatttcaacacgtgaagaatcgaagcgagggggtcggaaggtctaggaaagtgttaggggttcggggttttaatacgtgacagtgacgtagggtacaggttgtcggtccttcggctcgacgtaggttccgggacgggtacgggaccgaaaggggtcggaaagtaacgtaacgaaaacggtacgtggtacggctacggaccg

SEQ ID NO: 312265 - DNA, 559 bp, Homo sapiens
  misc_feature: GZ8MTXP02JNXK9.11.28.C06.1.454.CMB.2.raw
  modified_base (356)..(356): a, c, t, g, unknown or other
  misc_feature (356)..(356): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgctcgtcacccttggacagccggcctccatctcctgcaggtcaagtcagagcctcgttcacgataatgggaacacctacttgagttggtttcagcagaggcaggccaatctccaaggcgacctaatttagtaagtttctaggcggactcgtggggtccagacagattcagcggcnggtgggtacaggcgctgtatttcacactgagaatcaagcgaggggtggaggctagaaggtagtgggttacgggggtttattacgtgacgtagtgccgtaggggtacgaggttggtggccttcggcctcggcgtacggttccgggacgggacggggaccgaagggtggaagacgtaacgaaaacggacgtggtacggctaccgg

SEQ ID NO: 312266 - DNA, 580 bp, Homo sapiens
  misc_feature: GZ8MTXP02HYY9U.11.28.C06.1.454.CMB.2.raw
tcagcgagagataccacgaccggtgctcgatttagagctcacgtattgggtttgggactgatcaggactcctcagttcaccttctcacaatgaggctccctgctcagctcctggggctgctaatgctctgggtcccagtgtccagtggggatgttgtgttgactcagtctccactctccctgccccgtcacccttggacagccggcctccatctcctgcaggtcaagtcagagcctcgttcacgataagtggaacacctacttgagttggttcagcagagccaggccaatctccaaggcgacctaatttagtaaggtttctaggcggactcgtcggggtcccagaccagattcagcggcaggtggggtcagggcgcttgactttcactactagagaatcgagcgtaggggtgggaggctaggaagagttggttacggggtttattacgttgcagtcgagtagggtacgtaggtcgtggtccgttcgcctcggactagggttccgggcggggaacgggtaccgaaaggggtcggaaggtaacgtaccgaaaacggtaccgtggtacgggacttcggaaccc

SEQ ID NO: 312267 - DNA, 549 bp, Homo sapiens
  misc_feature: GZ8MTXP02HQGMI.11.28.C06.1.454.CMB.2.raw
  modified_base (524)..(524): a, c, t, g, unknown or other
  misc_feature (524)..(524): n is a, c, g, or t
tcagcgagagataccacgaccggtgctcgatttagagctcacgtattgggtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgccaggctccagggcaggggctggaatggatttcatacattggtgaaagtggcagtcccatataccacgcagactctgtgaagggccggttcaccatctccagggacaactaccaaaactcaactatatctagaaatgactagcctgagctcgaggacacggtcctttattactgtgcgacgcccgccgatagcagcatcatcacgtggggccagggggaccctgggtccaccgtctcctctcgccctccacgaacgggcccagtccggtccttccccctcggcccgtccctcggccctccgaacgggccnccgacccgtaccgacgacgaccacg

SEQ ID NO: 312268 - DNA, 544 bp, Homo sapiens
  misc_feature: GZ8MTXP02JQH6N.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctactgagttggttcagcagaggccaggccaatctccaaggcgacctaatttataaggtttcaggcggactcgtggggtcccagaccagattcagcggcaggtgggtcagggcgctgtatttcacactgagaatcagcgaggggtgaggctaggaagagttggttcggggtttattacgtgctagtgcgtagggtactaggtggtcggtccttcgctcacgtgttccgggacgggacgggaccgaagggtggaagaagtacgaaaacgacgtggtacgcgtcgaaccg

SEQ ID NO: 312269 - DNA, 520 bp, Homo sapiens
  misc_feature: GZ8MTXP02J2ONX.11.28.C06.1.454.CMB.2.raw
  modified_base (188)..(188): a, c, t, g, unknown or other
  misc_feature (188)..(188): n is a, c, g, or t
  modified_base (398)..(398): a, c, t, g, unknown or other
  misc_feature (398)..(398): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtgggatgttgtgttgactcagtctccactctccctgccccgtnacccttggacagccgcctccatctcctgcaggtcaagtcagagcctcgttcacgataatggacacctactgagttggttcagcagaggccaggccaatctccaggcgctatttataaggtttctaggcgggactcgtggggtcccagacccagattcagcggcagtggggtcaggcgctgatttcacactgagaatcagcaggggtgggngctgaagatgtcggggtttatactgcatgcaggtacagtggtgccgtttgcgttcgctagttcgggcgggaggggacccgaagggtggagtaagacaaacgaacgtagtcggtcgtcgaccg

SEQ ID NO: 312270 - DNA, 526 bp, Homo sapiens
  misc_feature: GZ8MTXP02GB2XW.11.28.C06.1.454.CMB.2.raw
  modified_base (412)..(412): a, c, t, g, unknown or other
  misc_feature (412)..(412): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctacttgagttggttcagcagaggccaggccaatctccaaggcgacctaaatttataaggtttctaggcgggactcgtggggtcccagaccagattcagcggcaggtgggcaggcgctgatttcacactgagaatcagcgagggtggaggctgaagntggttcggggtttatacgtgcagtgcgagggtacaggtgtggcctttcgctcgctacgttcgggcggacgggaccaaggggtggagaagtacgaaaacgtactggtggctgacc

SEQ ID NO: 312271 - DNA, 562 bp, Homo sapiens
  misc_feature: GZ8MTXP02IIVMY.11.28.C06.1.454.CMB.2.raw
  modified_base (388)..(388): a, c, t, g, unknown or other
  misc_feature (388)..(388): n is a, c, g, or t
  modified_base (431)..(431): a, c, t, g, unknown or other
  misc_feature (431)..(431): n is a, c, g, or t
  modified_base (493)..(493): a, c, t, g, unknown or other
  misc_feature (493)..(493): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatctcctgcaggtcaagtcagacgcctcgttcaacgataatgggaacacctactgagtttggttcagcagaggccaggccaatctaccaaggccgacctaaatttagtaaggtttctagggcggactcgtcggggtacccagaccagattcaggcggcaggtggggtcaggcgctagntttacacgactgaagatcgagcgtaggggtggaggctagaagngtgggttacggggtttatacgtgctagtgacgtagggtacaggttgtcggtcctcgctacgntacgttcgggacgggacggaccgaaagggtggacgtaagtaacgaaaacggtacgtgtcggctaggacc

SEQ ID NO: 312272 - DNA, 531 bp, Homo sapiens
  misc_feature: GZ8MTXP02FT7Y1.11.28.C06.1.454.CMB.2.raw
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaaggtttctaggcgggactcgtggggtcccagaccagattcgagcggcaggtgggtcagggcgctgatttcacactgagaatcagcaggggtggaggcgtagaagagtggttcggggtttattacgtgcagtgacgagggtacaggtgtgggccttcgctcgcagttcggcggagggaccgaaggtggaagaagtacgaaaacgacgtggtcggactgacc

SEQ ID NO: 312273 - DNA, 547 bp, Homo sapiens
  misc_feature: GZ8MTXP02IQC0T.11.28.C06.1.454.CMB.2.raw
  modified_base (383)..(383): a, c, t, g, unknown or other
  misc_feature (383)..(383): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacactacttgagttggttcagcagaggccaggccaatctccaaggcgaccttaatttataaggtttctaggcggactcgtggggtccagacagattcagcggcagtgggtcaggcgctgatttcacactganatcagcgaggggtggagcgtagaagagttggttacggggtttattacgtgctagtgcgtagggtacaggtgtcggtccgttcgcgtcgctacggttcgggacgggacggggaccgaaggggttggacgaagtacgaaaacggtaacgtggtacggacgtggacc

SEQ ID NO: 312274 - DNA, 561 bp, Homo sapiens
  misc_feature: GZ8MTXP02J1RWX.11.28.C06.1.454.CMB.2.raw
  modified_base (418)..(418): a, c, t, g, unknown or other
  misc_feature (418)..(418): n is a, c, g, or t
  modified_base (456)..(456): a, c, t, g, unknown or other
  misc_feature (456)..(456): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacactacttgagttggttcagcagacggccaggccaatcctaccaaggcgaccttaatttagtaaggtttctaggcggactcgtggggtcccagaccagattcgagcggcaggtcggggtcgacggcgtcgtgtactttcactacgtagaagaactcaggcgaggggnggaaggtctaggaagtagttggttacgggtttatacgngtacagtgcgaagggttacaggtgtcggtccttcgctcgacaggtccgggaggacggacgagggtaggaagaacgtaacgaaaacgacgttggtacggactgacc

SEQ ID NO: 312275 - DNA, 544 bp, Homo sapiens
  misc_feature: GZ8MTXP02HISLQ.11.28.C06.1.454.CMB.2.raw
  modified_base (412)..(412): a, c, t, g, unknown or other
  misc_feature (412)..(412): n is a, c, g, or t
tcagcgagagataccacgaccggtgctcgatttagagctcacgtattgggtttgggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataatggaacacctacttgagttggttcagcagaggccaggccaatctccaaggcgacctaatttataaggtttctaggcggactcgtggggtcccagaccagattcagcggcagtgggtcaggcgctgatttcacactgaagaatcgagcgagggtggaggctgaagngttggttcggggtttaattcgtgactagtagacgtagggtacaggtgtggtccttcgctcggctagttccgggacggacgggaccgaagggtcggaagaagtacgaaaacgtacgtggtacggcgtacgacc

SEQ ID NO: 312276 - DNA, 576 bp, Homo sapiens
  misc_feature: GZ8MTXP02HHAGC.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatctcctgcaggtcaagtcagacgcctcgttcacgataagtggaacacctacttgagttggttcagcagagccaggccaatctaccgaaggcgaccttaatttataaggtttctaggcggtactcgtcggggtaccagaccagatcagcggcagggtgggtcagggcgtctgtactttcgactacgtgaagaatcgagcgtaggggtggaagctagaagtagttggttacggggttttatacgtgtacgagttcgaccggtagggtacgtaggtcgtcggtcccgttcgcgttcgacgtggtccgggaggacggtaccgaaagggtggaagtaactacgaaaacgtacgtggtcgacgttacgaaccg

SEQ ID NO: 312277 - DNA, 518 bp, Homo sapiens
  misc_feature: GZ8MTXP02FU84B.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttcaggcgggactcgtggggtcccagaccagatcagcgcagtgggcaggcgctgatttcacactgagaatcagcgagggtggaggctgaagagtggttcggggtttattacgtgcagtgacgagggtacagtgtggccttcgctcgcagttcggcggacgggaccgaaggtggagaagtacgaaaacgacgtagtcgcgtgac

SEQ ID NO: 312278 - DNA, 540 bp, Homo sapiens
  misc_feature: GZ8MTXP02JG84M.11.28.C06.1.454.CMB.2.raw
  modified_base (308)..(308): a, c, t, g, unknown or other
  misc_feature (308)..(308): n is a, c, g, or t
  modified_base (363)..(363): a, c, t, g, unknown or other
  misc_feature (363)..(363): n is a, c, g, or t
  modified_base (538)..(538): a, c, t, g, unknown or other
  misc_feature (538)..(538): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgttcccagtgtccagtggggatgttgtgttgactcagtctccactctccctgcccgtcacccttggacagccggcctccatctcctgcaggtcaagtcagagcctgttcacgataatgggaacacctacttgagttggttcagcagaggccaggccaatctccaaggcgcctaatttanaaggtttcaggcggactctggggtcccagaccagatcagcggcagtgggcaggcnctgatttcacactgagaatccgagcgaggggagtggaggagtagaagtaggttaggtttagggtttactagtgacgtagtacggacgtagggtagtggtcgtcggtcctcgtctcggctcgggtacgggacggacgggacgaaggtagaagaacgtaacgaacgtagtcgagacncg

SEQ ID NO: 312279 - DNA, 611 bp, Homo sapiens
  misc_feature: GZ8MTXP02FQ4FD.11.28.C06.1.454.CMB.2.raw
  modified_base (397)..(397): a, c, t, g, unknown or other
  misc_feature (397)..(397): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataatggaacacctacttgagttggttcagcagaggccaggccaatctcaaggcgacctaaatttataaggtttcaggcggtactcgtggggtacccagaccagattcagcggcaggtggggtcagggcgctgtatttcacactgaagaatanagcgaggggtggaggctaggaaagagttagggtttacggggtttaattacgtgtactagtgacgtagggtacgtaggttggtcggtccgttcgtcgtccggtacgtacggtttccggggacggggaaacggggtaacccggtaaagggggtaggaaaggtaaacgttaacgaaaaaaccggtaacggttaggttacgggccgttacggaacccg

SEQ ID NO: 312280 - DNA, 561 bp, Homo sapiens
  misc_feature: GZ8MTXP02IXCYY.11.28.C06.1.454.CMB.2.raw
  modified_base (354)..(354): a, c, t, g, unknown or other
  misc_feature (354)..(354): n is a, c, g, or t
  modified_base (417)..(417): a, c, t, g, unknown or other
  misc_feature (417)..(417): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtggaacacctatgagttggttcagcagaggccaggccaatctcaaggctactaatttataaggtttcaggcggactcgtcggggtacccagaccagattcagcggnagtggggtcagggcgctgtatttcacactgaagaatcgaagcgaggggtggaggctaggaagngtaggttacggggtttattacgtgcatggacgagggtacaggtgtcggtccgttcgcgttcgacgtagttccggggacggaacgggtaccgaaaggggtcgaaaggtaactaacgaaaacggtactaggtcggacgtacggacc

SEQ ID NO: 312281 - DNA, 742 bp, Homo sapiens
  misc_feature: GZ8MTXP02GIDIM.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataagtggaacacctacttgagttggttcagcagagccaggccaatctacgaaggcaccttaatttagtaaggtttcagggcggtactcgtggggtcccagaccagtacttcgaggtccggatagggttcggggccaagggggtccgaccgttaggtactttttccgaaaccctaacgttaggaaacggaaataccgaagggccgggtaaagggggtcggggaaagggtccgttaagggaaaagggtacgtttgggggtttaaccgggggttttaaatttaccggttggaccgtaagttcgggaaccggtaacgggggttaaacgagggtttcgggttcgggtccccgttttcggaaacccggtaccggtcgttaaccgggtttccgggggaccggggtaaacgggggtaacccgaaaacgggggttcgggaaaaggttaaccgtaaaccggaaaacgggttaaccggtttggggaaacggggttaccgtacgtaccg

SEQ ID NO: 312282 - DNA, 523 bp, Homo sapiens
  misc_feature: GZ8MTXP02HGJVB.11.28.C06.1.454.CMB.2.raw
  modified_base (288)..(288): a, c, t, g, unknown or other
  misc_feature (288)..(288): n is a, c, g, or t
  modified_base (412)..(412): a, c, t, g, unknown or other
  misc_feature (412)..(412): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccattctccctgcccgtcacccttggacagccggcctccatctcctgcaggtcaagtcagagcctcgttcacgataatggaacacctactgagttggttcagcagagcaggccaatcncaaggcactaatttataaggtttctaggcggactcgtggggtcccagacccagattcgagcggcaggtgggtcagggcgctgactttcacactgagaatcgagcgaggggtggagctaggaagngttggtcgggtttatacgtgcagtgcgaggtacagtgtggctttcgctcgctagttcgggcggtacgggaccgagggtggagaagtacgaaacgactggtcggctcggacc

SEQ ID NO: 312283 - DNA, 576 bp, Homo sapiens
  misc_feature: GZ8MTXP02FNSWR.11.28.C06.1.454.CMB.2.raw
  modified_base (333)..(333): a, c, t, g, unknown or other
  misc_feature (333)..(333): n is a, c, g, or t
  modified_base (349)..(349): a, c, t, g, unknown or other
  misc_feature (349)..(349): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctacttgagttggttcagcagaggccaggccaatctccgaaaggcgaccttaatttataaggtttcaggcggactcgnggggtcccagaccagntcagcggcagtgggtcaggcgctgatttcacactgaagaatcagcgaggggtgaggctagaaagtgttaggttacgggggtttaattacgtgctagttgacgtagggtacaggttggtcggtcccgtttcggccgtcggcgttaaggttcccgggacggggtaacggggaccgtaaaagggtggaagaacgtaacgaaaacggtaacgtggtacggcgtcggaaccc

SEQ ID NO: 312284 - DNA, 549 bp, Homo sapiens
  misc_feature: GZ8MTXP02JRA0R.11.28.C06.1.454.CMB.2.raw
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccgaaggcgtacctaatttataaggtttcaggcggactcgtcggggcccagaccagattcaggcgcaggtgggtcaggcgntgatttcacactgaanatcagcgagggtggaggctagaagtacgttgggttacggggtttaatacgtgactagtgacgtagggtacaggtggtcgccgtttcgctcgctaggtcgggacgggacgggaccgaaggggtgaagtaacgtacgaaaacgtacgtggcgtcgtacgacc

SEQ ID NO: 312285 - DNA, 574 bp, Homo sapiens
  misc_feature: GZ8MTXP02JW9IF.11.28.C06.1.454.CMB.2.raw
  modified_base (290)..(290): a, c, t, g, unknown or other
  misc_feature (290)..(290): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtggaacacctactgagttggttcagcagagccaggccaatcnccaaggcacttaatttataaggtttcaggcggactcgtcggggtcccagaccagtattcgagcggcaggtggggtcagggcgctgactttcacactgagaatcgagcgaggggtggaggctaggaagtagttgggttacggggtttaattacgtgactagtggacgtagggtacaggtcggtcggtcccttcgctcggacgtaggttccggggacgggaacgggaccgtaagggtggtaagaacgtaaccgaaaacgtacgtcggtacgggtctcggtaacccg

SEQ ID NO: 312286 - DNA, 586 bp, Homo sapiens
  misc_feature: GZ8MTXP02GUUX1.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtggaacactacttgagttggttcagcagacggccagccaatctaccaaggctacttaatttagtaacggtttcaggcggactcgtcggggtcccagaccagattcgaggcggactaggtggggtacagggcgtacgtgtactttcactacgtgaagatcgagcgagggtggacgcgtaggaagtagttgggttacgggtttatacgtgctagtgacggaagggtacaggtcggtcggtccgttcgcgtcggacgtaggttccggggacgggtaacggggaaccgtaaggggtcggaaagtaacgtaacgaaaacggtactggtacggtctacggaacc

SEQ ID NO: 312287 - DNA, 566 bp, Homo sapiens
  misc_feature: GZ8MTXP02GT8KY.11.28.C06.1.454.CMB.2.raw
  modified_base (463)..(463): a, c, t, g, unknown or other
  misc_feature (463)..(463): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataagtgggaacacctacttgagttggttcagcagaggccaggccaatctccaaggcacctaaatttataaggtttcaggcgggtactcgtcggggtcccagaccagattcaggcggcagtggggtcagggcgctgatttcacactgaagaatcgagcgaggggtggaggctaggaagagttggtcggggtttaattacgtgtctagtgacgtagggtacnggttgtcggtccgtttcgcgtcgctacggttcgggacgggacgggtacccgaagggtcggaagaacgtaacgaaaacggtaccgtaggtcggactacggaccc

SEQ ID NO: 312288 - DNA, 549 bp, Homo sapiens
  misc_feature: GZ8MTXP02GMG2W.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttgtacagccggcctccatctcctgcaggtcaagtcagagcctcgttcacgataatggaacacctacttgagttggttcagcagaggccaggccaatctcaaggcgacctaatttataaggtttctaggcggtactcgtggggtcccagaccagattcagcgcagtgggtcagggcgctgatttcacactgaagatcagcgaggggtggaggcgtagaagagttggttcggggtttatacgttgactagtgcgtagggtacaggtgtggccgtttcgcgttcgcgtagttcgggacgggacggggaccgaaggggtggaagtaagtacgaaaacggacgtggtcggaccgtgacccg

SEQ ID NO: 312289 - DNA, 529 bp, Homo sapiens
  misc_feature: GZ8MTXP02JTCCM.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttgttcagcagagccaggccaatctccaaggcgacctaatttataaggtttctaggcggactcgtggggtcccagaccagattcagcggcagtgggtcaggcgactgatttcacactgagaatcagcgagggtcggaggcgtagaagatggttcgggggtttattacgttgctagtgcgagggtacagtgtggcttcgctcgcagttcggcggagggaccgagggtacggagaagtacgaaaacggactggtcggcgtagaccg

SEQ ID NO: 312290 - DNA, 523 bp, Homo sapiens
  misc_feature: GZ8MTXP02GXBXG.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcggactcgtggggtccagaccagattcagcgcaggtggggtcaggcgctgatttcacactgagaatcagcagggtgagctagagatggtcggggtttatacgtgcagtgacgagggtacaggttcgtggccgttcgcgtcgcgtagttccgggcggagggaccgaaggtcggagaagtacgaaacgaactgtaggctcgac

SEQ ID NO: 312291 - DNA, 560 bp, Homo sapiens
  misc_feature: GZ8MTXP02I7DZ7.11.28.C06.1.454.CMB.2.raw
  modified_base (389)..(389): a, c, t, g, unknown or other
  misc_feature (389)..(389): n is a, c, g, or t
  modified_base (484)..(484): a, c, t, g, unknown or other
  misc_feature (484)..(484): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataatgggaacacctacttgagttggtttcagcagaggccaggccaatctccaaggcgcctaatttataaggtttctaggcggactcgtggggtcccagaccagattcagcggcaggtggggtcagggcgctgatttcactactganaatcaggcgaggggtggaggcgtagaagagtggttcggggtttattacgtgtacagtgacgagggttacaggttggtcggtccttcggcttcggngtacgttcggggacgggacgggaccgaagggtcggaagaacgtacgaaacgaacgtcggtacggcgttaggaaccc

SEQ ID NO: 312292 - DNA, 561 bp, Homo sapiens
  misc_feature: GZ8MTXP02J29BY.11.28.C06.1.454.CMB.2.raw
  modified_base (232)..(232): a, c, t, g, unknown or other
  misc_feature (232)..(232): n is a, c, g, or t
  modified_base (380)..(380): a, c, t, g, unknown or other
  misc_feature (380)..(380): n is a, c, g, or t
  modified_base (464)..(464): a, c, t, g, unknown or other
  misc_feature (464)..(464): n is a, c, g, or t
  modified_base (479)..(479): a, c, t, g, unknown or other
  misc_feature (479)..(479): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagcccggcctccatctcctgcaggtcaagtcagngcctcgtcacgataagtggaacactacttgagttggttcagcagacggccaggccaatcctcgaaggcaccttaatttagtaacggttctaggcggactcgtcggggtccagacccagtatcgagcggcagggtcgggcaggggtccngtagtactttacgacacgtagagtaatcgaaggcgaggggtggaaggtctaggaagtagtggttacggggtttactacgtgacngtgcgagggttacgnggtcgtcgtccgtcgcgtcgcgtcggtcgggacggacggacgacgggtagaacgaacgtaacgaacgtacgtgcggtcacgc

SEQ ID NO: 312293 - DNA, 507 bp, Homo sapiens
  misc_feature: GZ8MTXP02FG580.11.28.C06.1.454.CMB.2.raw
  modified_base (298)..(298): a, c, t, g, unknown or other
  misc_feature (298)..(298): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttgacagccggctccatctcctgcaggtcaagtcagagcctcgttcacgataatgggaacacctacttgagttggttcagcagaggccaggccaatctccaaggcncctaatttataaggtttcaggcgggactcgtggggtccccagacccagatcagcggcagtggtcaggcgctgatttcacactgagaatcagcgaggtggaggctgaagatgtcggggttatactgcatgcagggtacagtgtggccttcgctcgcagttcggcggacgggaccgaaggtggagaagtacgaaaacgaactgtggctgcc

SEQ ID NO: 312294 - DNA, 565 bp, Homo sapiens
  misc_feature: GZ8MTXP02IKGN8.11.28.C06.1.454.CMB.2.raw
  modified_base (382)..(382): a, c, t, g, unknown or other
  misc_feature (382)..(382): n is a, c, g, or t
  modified_base (418)..(418): a, c, t, g, unknown or other
  misc_feature (418)..(418): n is a, c, g, or t
  modified_base (499)..(499): a, c, t, g, unknown or other
  misc_feature (499)..(499): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtgggatgttgtgttgactcagtctccactctccctgcccgtcacccgttggacagccgcctcatctcctgcaggtcaagtcagacgccttcgtcaacgtataagtgggaactacctacttgtagtttggttcagcagacggccaggaccaatccgtaccgaaggccgtaccttaaattttaagtaaggttttcgtagggcggtacttcgtcggggtacccagaccagtatcgagcgnaggtgggtcaggcgtctgtatttacacactgaatancagcgagggtgagctagaagtagttgggttacgggtttaatacgtgactagtcgacgtaggtacaggtgtcgctgctacgntacggtcggacggaacggaccgaagggtcgaagtaagtaacgaaacgtacgtgtcggactacgacc

SEQ ID NO: 312295 - DNA, 702 bp, Homo sapiens
  misc_feature: GZ8MTXP02JMY5U.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtgggatgttgtgttgactcagtctccactctccctgcccgtcacccttggacacgccgcctccatcctcctgcaggtcaagtcagacgcctcgttcacgataagtggaaccaccttactggtagtttggttcagcaggacggccaggaccaaatccgtaccgaaggccgtaccttaaagttttagtaagggttttcgaacggggtccgggtacttcggtcggggtaccccaaggtacccaaggtacttacgacggcggactagggttcggggtcgacggggtcgtcgttaggtactttacgaactacgttaggaaacgtaacgtacgaagggacgggtaagggggttacggggaagggtaccggtaagggaaaaggttggttaggggtttaaccgggggttttaattacggtgtacgtaaggtcggacgtaggggtactaggttcgggtacgttcccgttcgtccgtcgtacgtcgggttacggggacgggtaacggtaaccggaagggtaggaaacgtaagtaaacgaaacggtacgtggtacggctacggaaccc

SEQ ID NO: 312296 - DNA, 547 bp, Homo sapiens
  misc_feature: GZ8MTXP02FNF5Q.11.28.C06.1.454.CMB.2.raw
  modified_base (298)..(298): a, c, t, g, unknown or other
  misc_feature (298)..(298): n is a, c, g, or t
  modified_base (354)..(354): a, c, t, g, unknown or other
  misc_feature (354)..(354): n is a, c, g, or t
  modified_base (409)..(409): a, c, t, g, unknown or other
  misc_feature (409)..(409): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggctccatctcctgcaggtcaagtcagagcctcgttcacgataatggaacacctacttgagttggttcagcagaggccaggccaatctccaaggcncctaaatttataaggtttcagggcggactcgtggggtcccagaccagatcagcggnagtggggcaggcgctgatttcacactgagaatcagcgagggtggaggctgaaagnttggttcggggtttaattacgtgacagttgcgagggtacaggtcgtcggtcctttcgcgtcgcgtagttccggggacgggaacgggaccgaaaggggtggaagaacgtacgaaaacggtactggtcggctaggacccg

SEQ ID NO: 312297 - DNA, 532 bp, Homo sapiens
  misc_feature: GZ8MTXP02JXTQ6.11.28.C06.1.454.CMB.2.raw
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctactgagttggttcagcagaggccaggccaatctccaaggcgacctaatttataaggtttctaggcaggactcgtcggggtccagacagattcagcggcnggtgggcagggtcnctgatttcacactgagaatnagcagggtggagctagaagatggttacggggtttatagtgctaatgacgagggtacaggtggtcggtccttcgacgtcgcgacggttcgggcgggacgggaccgaagggtaggaagactacgaaacgacgtgtacggctacg

SEQ ID NO: 312298 - DNA, 530 bp, Homo sapiens
  misc_feature: GZ8MTXP02IZK64.11.28.C06.1.454.CMB.2.raw
  modified_base (290)..(290): a, c, t, g, unknown or other
  misc_feature (290)..(290): n is a, c, g, or t
  modified_base (414)..(414): a, c, t, g, unknown or other
  misc_feature (414)..(414): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgccccgtcacccttggacagccggcctccatctcctgcaggtcaagtcagagcctcgtcacgataatgggaacacctacttgagttggttcagcagaggccaggccaanctccaaggcgcctaatttataaggtttctaggcgggactcgtggggtcccagaccagattcagcgcagtggggtcaggcgctgatttcacactgagaatcgagcgaagggtggaggctagaagntggtcggggtttattacgtgcatgacgagggtacaggtgtggtccgttcgctcgctagttccggcgggtacgggaccaaggggtgagaagtcgaaaacgacgtgtacggcgtgacc

SEQ ID NO: 312299 - DNA, 546 bp, Homo sapiens
  misc_feature: GZ8MTXP02HOASW.11.28.C06.1.454.CMB.2.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
  modified_base (307)..(307): a, c, t, g, unknown or other
  misc_feature (307)..(307): n is a, c, g, or t
  modified_base (464)..(464): a, c, t, g, unknown or other
  misc_feature (464)..(464): n is a, c, g, or t
  modified_base (533)..(533): a, c, t, g, unknown or other
  misc_feature (533)..(533): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtccagtgtccaggtggggatgttgtgttgactcagtctccactctccctgcccgtcacccttggacagccggcctccatctcctgcaggtcaagtcagagcctcgtcacgataagnggaacactacttgagttggttcagcagagcagcaatcncaagcactaattataaggttnaggcggactcgtggggtccagaccagatcgagcggacgagtggggtcaggcgctagtactttacacactgaagtaatcgagcgaggggtggaggcagaagtagttgggttacggggttttaattacgttgacgtagtggacgagggtacaggttggnggtccgttcgctcgctagtcgggacgggaacggaccgaagggtaggaagtaagtacgaaaacggtacgnggtcgacgtgacc

SEQ ID NO: 312300 - DNA, 547 bp, Homo sapiens
  misc_feature: GZ8MTXP02H0V8Y.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatctcctgcaggtcaagtcagagcctcgttcacgataatgggaacacctacttgagttggttcagcagagccaggccaatctcaaggcactaatttataaggtttcaggcggactcgtcggggtccagaccagtacttcagcggcaggtggggtcaggccgctgatttcacactgagatcagcgagggtggagctagagagtggttcgggtttattacgtgcagtgacgtagggtactaggtgtcggtccttcgcttcggcgttacggttccggggacgggtacgggtaccgaaagggtcggaagtaagtacgaaaacgtacgtgacggtctacggacc

SEQ ID NO: 312301 - DNA, 560 bp, Homo sapiens
  misc_feature: GZ8MTXP02I8JED.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccaaggcgcctaatttataaggtttctaggcgggactcgtggggtcccagaccagattcagcggcagtgggtcagggcgctgatttcacactgagaatcagcgagggtggaggctagaagagttaggttcgggggttttaattacgtgctagtggacgtaggggtacaggtgtcggtccttcgctcgctagttcgggacgggtacggggaccgaaggggtcggaaggaagttacgaaaacggtaacgtggtacggtcgtacggacccg

SEQ ID NO: 312302 - DNA, 559 bp, Homo sapiens
  misc_feature: GZ8MTXP02J1AB1.11.28.C06.1.454.CMB.2.raw
  modified_base (290)..(290): a, c, t, g, unknown or other
  misc_feature (290)..(290): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatctcctgcaggtcaagtcagacgcctcgttcacgataagtggaacacctactgagttgttcagcagcgcaggccaatcncaagcactaattagtaaggttcaggcggctcgtcggggtccagaccagtatcgaggcgcgaggtggggtcaggcgctgtactttcactacgtagaagaactacgagcgtagggggtggaggtcgtaggaagtagttgggttacggggtttatacgtgacgtagtgacgaggggttacaggttcgtcggtccttcgctcgtcgtaggttccggggaggacgggacgaaggggtgaagtaacgtaacgaaacggacgtggtcggctcgacc

SEQ ID NO: 312303 - DNA, 561 bp, Homo sapiens
  misc_feature: GZ8MTXP02GWA4S.11.28.C06.1.454.CMB.2.raw
  modified_base (277)..(277): a, c, t, g, unknown or other
  misc_feature (277)..(277): n is a, c, g, or t
  modified_base (340)..(340): a, c, t, g, unknown or other
  misc_feature (340)..(340): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctcatctcctgcaggtcaagtcagacgcctcgttcacgataagtggaaccacctattgagttggttcagcagnggcaggcaatcacaagcactaattatagttcaggcggatcgtcgggccagaccatatcagcgnagtgggcaggcgctagactttcactactagaagatcgagcgtaggggtggaggtacgtaggaaagtagtttagggttacggggtttaatacgtgactagtcggacgtaagggtactaggttggtcggtccttcggcgtcgcgttaggttccgggacgggaaacgggaccgtaaggggtggaagaacgtaacgaaaacggtacgttaggcggactacggacc

SEQ ID NO: 312304 - DNA, 666 bp, Homo sapiens
  misc_feature: GZ8MTXP02HYYU2.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctcgcccgtcacccttggacacgccgcctcatcctcctgcaggtcaagtcagacgccttcgttacaacgtaataagtcgggaaacctaccgttacttggtagtttggttccagcaggacggaccaggccaatcctaccgaaggtcctaccttaaatttagtaaggtttcgtagggcggtactcgtcggggccagaccagtactcgaggcggacgtagggtcggggtacacgggtcgtcgttagtactttcgaacgtacgtagaagtaaacgtcgaggacggtagggggtcggaaggtcgtaaggaagtaggttaggtttacggggtttattacgtgactaggtcggacgtagggtactaggttcggtcggtccttcggcgtacggtacgttacgggtccggggacggggtaaacggtaccggtaaacggggtggaaacgtaacgtaaccgaaaaacggtacgtggtacggtacgttacggaacccg

SEQ ID NO: 312305 - DNA, 612 bp, Homo sapiens
  misc_feature: GZ8MTXP02JGN3V.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatctcctgcaggtcaagtcagacgtccttcgttacaacgataagtgggaaaccaccttacttgagttggttcagcagaggccaggccaatcctaccaaggctaccttaaatttagtaaggtttcgaggcggtactcgtcggggtaccagacccagtatcaggcggcgaggtcggggtcaggccgtacgtgtactttaccgactacgtagaagtaactcgaggcggtaggggtagggaggtacgtaggaaagtagttacggggtttacggggtttaattacgtgacgtagtggacgtagggtactaggtgtcggtccttcgctcgacgtaggtccgggacgggtacggaccgaagggtcgaaggaacgtaacggaaaaccgtacgtaggtcggacgtagaacccg

SEQ ID NO: 312306 - DNA, 547 bp, Homo sapiens
  misc_feature: GZ8MTXP02FLGGA.11.28.C06.1.454.CMB.2.raw
  modified_base (420)..(420): a, c, t, g, unknown or other
  misc_feature (420)..(420): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctccgaaggcgacctaatttataaggtttcgtaggcgggtactcgtggggtcccagaccagattcagcggcaggtgggtcaggcgctgatttcacactgagaatcgagcgaggggtggaggcgtgaaagngtgggttcggggtttattacgtgctagtgcgaggggtacaggtggtggtccgttcgctcggcaggttcgggacgggacgggtaccgaagggtggaagaacgtacaaacggactggtacggctcgacc

SEQ ID NO: 312307 - DNA, 557 bp, Homo sapiens
  misc_feature: GZ8MTXP02H9G8O.11.28.C06.1.454.CMB.2.raw
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacnctactgagttgttcagcagagcagcaatcncaagcactattatagttnaggcggactcgtaggggtccagaccagatcagcgnaggtggcaggcgntgtatttcacactgaagatcgagcgaggggtggaggcgtaggagtagtaggttcggggtttaatacgttgacgtagtgacgagggtactaggtggttcggccgtttcgcgttcgacgttcggttaccgggacggggaacgggaaccgtaaggggtaggaaagtaacgtaaccgaaaacggtacgtaggtcggtaacgttcggaaccc

SEQ ID NO: 312308 - DNA, 590 bp, Homo sapiens
  misc_feature: GZ8MTXP02I6B37.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatctcctgcaggtcaagtcagacgcctcgttcacgataatggaacacctacttgagttggttcagcagaggccaggccaaatcctaccaaggcctaccttaaattttataaggtttctaagggcggtactcgtcggggtcccagaccagattcgagcggcaggtggggtcagggcgctgtactttcacacgtgaagatcagcgaggggtggaggcgtaggaagtagttaggggttacggggttttaattacgtgtacgtagttgacgtaggggtacaggttggtcggtccgttcgcgtcggcgtaggttccgggacgggacgggtaccgaaaggggtcggaagtaacgtacgaaaacgtacgtggtcgacgtacgaaccg

SEQ ID NO: 312309 - DNA, 541 bp, Homo sapiens
  misc_feature: GZ8MTXP02FQT7G.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggttcagcagaggccaggccaatctcaaggcgcctaaatttataaggtttctaggcgggactcgtggggtcccagaccagatcagcggcagtggggtcaggcgctgatttcacactgagaaatcagcgagggtggaggcgtgaaagagtggttacggggtttattacgtgcagtgcgagggtacaggttgtcgggtccttcggcttcgcagtttcgggcggtacgggaccgaaagggtggagaagtacgaaaacgtacgtagtcggctagaccg

SEQ ID NO: 312310 - DNA, 606 bp, Homo sapiens
  misc_feature: GZ8MTXP02IW62K.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgtcacgataatgggaacacctacttgagttggttcagcagaggccaggccaatctccaaggcacctaatttataaggtttctaggcggactcgtggggcccagacccagattcgagcggcagtggggtcaggcgctgactttcacactgagaatcgagcgaggggtggaggtcgagaagagttgggttaccgggggttttaaattccgttggactaggtacgacgtaacgggttactaggttcgggttcggtcccgtttcggccgttcggccgttaaggtttccggggacggggtaacggggtaacccgtaaggggtacgggaagtaacgtacggaaaaaccgtaacgtggtacggcgttacggaacccg

SEQ ID NO: 312311 - DNA, 574 bp, Homo sapiens
  misc_feature: GZ8MTXP02I146P.11.28.C06.1.454.CMB.2.raw
  modified_base (350)..(350): a, c, t, g, unknown or other
  misc_feature (350)..(350): n is a, c, g, or t
  modified_base (473)..(473): a, c, t, g, unknown or other
  misc_feature (473)..(473): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatctcctgcaggtcaagtcagagcctcgttcacgataagtggaacacctacttgagttgttcagcagaggccaggccaatctaccgaaggcgaccttaatttagtaaggtttctaggcggtactcgtcggggtccagacagnttcagcgcaggtgggtcgaggcgctgtatttcacacgtagaagaatcgaggcgaggggtggaggcgtaaggaaagtgttaggttggggttttaatacgtgacagtgacgtaggtacaggttgnggtccttcgcgttcgcgtagtccggggacgggtaacgggaccgaaaagggtggaagtaacgtaacgaaaacggtaaccggtggtacggtacgtacgacccg

SEQ ID NO: 312312 - DNA, 512 bp, Homo sapiens
  misc_feature: GZ8MTXP02IAT4L.11.28.C06.1.454.CMB.2.raw
  modified_base (406)..(406): a, c, t, g, unknown or other
  misc_feature (406)..(406): n is a, c, g, or t
  modified_base (444)..(444): a, c, t, g, unknown or other
  misc_feature (444)..(444): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatctcctgcaggtcaagtcagagcctcgttcacgataatggaacactacttgagttggttcagcagagccaggcaatctccaaggcgaccttaatttagtaaggtttctaggcggactcgtggggtcccagccagatcagcggcagtgggtcaggcgctgatttcacactgagaatcagcgagggtggagcgtagagngttggttcggggtttatacgtgcagtcgagagggtacnggtggtggccttgctcgcagttcggacggaggacaggtgacgaagtacgaaacgactggtcgctagac

SEQ ID NO: 312313 - DNA, 629 bp, Homo sapiens
  misc_feature: GZ8MTXP02J2G5K.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtggaacacctacttgagttggttcagcaggacggccaggaccaatcctaccgaaggcgtaccttaaatttagtaacggtttctagggcggtactcgtcggggtccccagaccagtattcgaggcggcaggtgggtcagggcgctagtatttcactacgtagagaatcgaggcgagggggtgaggcgtaggaagtagttgggttacggggttttaactacgtggtactagtcgacgtacggggttaactagggttcgtcgggtcccgtttcggcgttccggacgtacggttccggggacggggaacgggtaccgaaagggggttacggaaacgtaacgtaaaccgaaaacggtaacgtcgggttacggacgtacggtacccg

SEQ ID NO: 312314 - DNA, 552 bp, Homo sapiens
  misc_feature: GZ8MTXP02H76UO.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatctcctgcaggtcaagtcagagcctcgttcacgataagtggaacacctacttgagttggtttcagcagaggccaggccaatctccaaggcgcctaatttataaggtttctaggcggactcgtggggtccagacagattcgagcgcagtggggtcgaggcgcgtgagtttcactactgacaatcgagcgaggggtcggaggtcgtagagtagtggttacggggttttatacgtgtactagtgacgagggtacaggtcgtggtccttcgcttcgactcggttcgggcgggaacgggacgaaagggtcggaagaagtcgaaaaacgacgtggtacggctacggacc

SEQ ID NO: 312315 - DNA, 542 bp, Homo sapiens
  misc_feature: GZ8MTXP02JNJ4M.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctacttgagttggttcagcagaggccaggccaatctccaaggcgacctaatttataaggtttctaggcgggactcgtggggtcccagaccagattcagcggcaggtgggtcaggcgctgatttcacactgaagaatcagcgagggtggaggcgtagaagtagttgggttacggggtttattacgtgctagtgacgagggtactagtggtcggtccttcgcgttcgcgtagttcgggacgggacggaccgagggtgagaatacgaaaacgtagtcggtggctacgacc

SEQ ID NO: 312316 - DNA, 589 bp, Homo sapiens
  misc_feature: GZ8MTXP02JGW5J.11.28.C06.1.454.CMB.2.raw
  modified_base (277)..(277): a, c, t, g, unknown or other
  misc_feature (277)..(277): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatctcctgcaggtcaagtcagacgcctcgttcacgataagtggaacacctattgagttggttcagcagngccaggccaatctcaaggcgacctaatttataaggtttctaggcggtactcgtcggggtccagaccagattcagcggacagtggggtcaggcgctgtatttcacactgagaatcgagcgaggggtggaggcgtaggaaagtagttggttacggggttttattacgtgactagtagcgtaagggtacaggttggtcggtcccgttcgcttcggacgtaggttccgggacggggtaacgggaaccgtaaacggggttggaacggtaacgttaacgaaaaaccggtacgtagggtacggtaccgtacggaacccg

SEQ ID NO: 312317 - DNA, 575 bp, Homo sapiens
  misc_feature: GZ8MTXP02JIVY4.11.28.C06.1.454.CMB.2.raw
  modified_base (231)..(231): a, c, t, g, unknown or other
  misc_feature (231)..(231): n is a, c, g, or t
  modified_base (358)..(358): a, c, t, g, unknown or other
  misc_feature (358)..(358): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagngcctcgttcacgataatgggaacacctactgagttggttcagcagaggccaggccaatctaccaaggcgacctaatttataaggtttctagggcggactcgtggggtcccagaccagattcagcggnagtgggtcaggcgctgatttcactactgagaatcgagcgagggtggaggcgtagaagtagttagggttacggggttttaattaccgttgactagtgacgtagggtaactaggtggtcggtccgttcgcgtcggtcgtaggttccgggcgggaacggggtaccgaacggggtaggaagtaacgtaacgaaaacggtacgtggtacggcgtacggaccg

SEQ ID NO: 312318 - DNA, 619 bp, Homo sapiens
  misc_feature: GZ8MTXP02I9CAH.11.28.C06.1.454.CMB.2.raw
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgtcacgataatgggaacacctacttgagttggttcagtcagaggccaggccaatctaccaaggcacctaatttataaggtttctaggcggactcgtggggtaccagaccagattcagcggcagtggggtcagggcncgtgtatttcacactganaatcgagcgtaaggggtcggaaggcgtaggaaagtgttaggggttacggggttttaattacgttagactagtacggacgtaaggggtactagggttggttcgggtcccgttcggtccttacggctaacgggtttcggggaacggggtaaacggggacccgaaaacgggggtggaacggtaaacgttaccggaaaaacggaacgttggtacgggtcttacggtaacccg

SEQ ID NO: 312319 - DNA, 499 bp, Homo sapiens
  misc_feature: GZ8MTXP02IAKTG.11.28.C06.1.454.CMB.2.raw
  modified_base (402)..(402): a, c, t, g, unknown or other
  misc_feature (402)..(402): n is a, c, g, or t
  modified_base (433)..(433): a, c, t, g, unknown or other
  misc_feature (433)..(433): n is a, c, g, or t
  modified_base (496)..(496): a, c, t, g, unknown or other
  misc_feature (496)..(496): n is a, c, g, or t
tcagcgagagataccacgaccggtgctcgatttagagctcacgtattgggtttgggctgatcaggactcctcagttcaccttctcacaatgaggctccctgctcagctcctgggctgctaatgctctgggtcccagtgtccagtggggatgttgtgttgactcagtctccactctccctgcccgtcacccttggacagccggcctcatctcctgcaggtcaagtcagagcctcgtcacgataatggaacactacttgagttggttcagcagaggccaggccaatctccaaggcgcctaatttataaggtttctaggcggactcgtggggtcccagaccagattcagcggcagtggggtcaggcgtctgatttcacactgagaatcagcagggtgagctgagntggtcgggtttatactgcatgcgaggtacgngtgtgtctcgctcgctagtcggacggacggacgaggtgagaacgtacgaaacgacgtgcgtcncgc

SEQ ID NO: 312320 - DNA, 584 bp, Homo sapiens
  misc_feature: GZ8MTXP02FW724.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatcctcctgcaggtcaagtcagacgcctcgttcacgataagtggaacactacttgagttggttcagcagacggccaggccaatctaccgaggcacttaatttagtaaggtttcgtagggcggtactcgtcggggtacccagaccagacttcgagcggcagggtgggtcaggtcgctgtatttcaactacgtagagaatcgaagcggtaggggtggaaggtcgtagaaagtgttggggttacggggtttattacgtgcgtagtgacgagggtacgaggttgtcggcttcgcgtcgctaggttcgggacgggacggaccggtaaagggtggtaacgaacgttaaacgaaaacggtaacgtggtacgccgtagacccg

SEQ ID NO: 312321 - DNA, 592 bp, Homo sapiens
  misc_feature: GZ8MTXP02FSMYI.11.28.C06.1.454.CMB.2.raw
  modified_base (375)..(375): a, c, t, g, unknown or other
  misc_feature (375)..(375): n is a, c, g, or t
  modified_base (386)..(386): a, c, t, g, unknown or other
  misc_feature (386)..(386): n is a, c, g, or t
  modified_base (469)..(469): a, c, t, g, unknown or other
  misc_feature (469)..(469): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtggaacacctacttgagttggttcagcagaggccaggccaatctaccaaggcgtaccttaaatttagtaaggtttctaggcggtactcgtggggtcccagaccagatcgagcgcagtgggcagggcnctgactttcanactgagaatcagcgagggtggagcgtaggaagtgttagggttacggggtttattacgtgacgtagtacgacgtaagggtacgnggttcggttcggtccgtttcgccgtcggtacggttacggttccggggacggggtaacggggtaaccgaaggggtggaaagtaacgtaaacgaaaacggtacgtcggtaggccgtacgaacccg

SEQ ID NO: 312322 - DNA, 691 bp, Homo sapiens
  misc_feature: GZ8MTXP02JCAI4.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctcgcccgtcacccttgacacggccgcctcatctcctgcaggtcaagtcagacgtcctcgtcaacgtataagtcgggaaccaccttattggtagtttggttcagcagacggccaggccaatcctaccgaaggccgtacctttaaatttagtaaggtttcgtagggccggtacttcggtcggggtcccaagaccagtacttcgaggcggacgtagggtcggggtcagggcgtacgtgtactttcaactacgtgaaagtatacgaggcggaagggggtggagggtcgtaggaaaggtgtttagggggtttaccggggttttaattacggttgaccgtaggtacggacgtaaggggtactagggttcggtcggtcccgttgcccgttcggacggttaccggttaccgggggacggggtaaaccgggtaaccgggtaaaaggggttcgggaaaacgtaacggttaaaaccggaaaaccggttaggttcggggtaccggtacgttacggaaccccg

SEQ ID NO: 312323 - DNA, 572 bp, Homo sapiens
  misc_feature: GZ8MTXP02HIVQB.11.28.C06.1.454.CMB.2.raw
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
  modified_base (366)..(366): a, c, t, g, unknown or other
  misc_feature (366)..(366): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatcctcctgcaggtcaagtcagacgcctcgttcacgataagtggaacactattgagttgttcagcagngcagcaatcncagctactaattatagtttnaggcggatcgtcgggtccagaccagattcagcggnaggtgggtcaggcgctgtattcanactgagtaatgagcgaggggtcggaggcgtagaacgtagttgggttacgggttttaatcgttagctagtgacgtagggttacgtaggtggtcggtccgtttcggcctacggtccgttaagggttccgggacggggaacgggacccgtaaaggggttaggaacgtaacgtacgaaaacggtaacgtgggtacggcgttacggacccg

SEQ ID NO: 312324 - DNA, 562 bp, Homo sapiens
  misc_feature: GZ8MTXP02JRM7Y.11.28.C06.1.454.CMB.2.raw
  modified_base (369)..(369): a, c, t, g, unknown or other
  misc_feature (369)..(369): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataatgggaacacctacttgagttggttcagcagaggccaggccaaatcctaccgaaaggccgtaccttaaatttataaaggtttctagggcggtactcgtcggggtcccagaccagatcagcgnagtgggtcaggcgctgatttcgactactgaagatcgagcgagggtggagctagaagagttggtacgggtttaatacgtgctaagtgacgagggtacaggtgtcggtccttgcgttcgccgtagttcgggacgggaacgggaccgaagggtaggaagaagtaacgaaaaccggtacgtggtcggactcggaacc

SEQ ID NO: 312325 - DNA, 517 bp, Homo sapiens
  misc_feature: GZ8MTXP02FPCCW.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctacttgagttggttcagcagaggccaggccaatctccaaaggcgacctaatttataaggtttctaggcgggactcgtggggtcccagaccagatcagcgcagtgggtcaggcgctgtatttcacactgaagaatcagcgagggtggagcgtgaagtgtggtcgggtttatacgtgcatgcgaggtacagtgtggcctcgctcgcagttcggcggaggaccgaaggtggaagaagtacgaaaacgactaggtcggactcgac

SEQ ID NO: 312326 - DNA, 675 bp, Homo sapiens
  misc_feature: GZ8MTXP02IH52P.11.28.C06.1.454.CMB.2.raw
  modified_base (375)..(375): a, c, t, g, unknown or other
  misc_feature (375)..(375): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataagtggaacacctactgagttgttcagcagaggccaggccaatctaccgaaggcgtacttaatttagtaaggtttcgaggcggactcgtcggggtccagaccagatcgagcggcaggtcgggtcaggcnctgtattacacgtactgaacaatcgaaggcgtagggggtagggacggtacgtaggaaagtagttacgggtttaccgggggttttaaattacggttgaccgttaaggtacggacggttaacggggtaaactcggggtttacggtaccgggttcccgtttaccgggaccgtttcggtaacgttacgggttacccggggtaaccgggggaaacggggttacccggaaaagggggttacggaaacggtaacgttaaaccggaaaaaccggttacgtacggttaacggccgtttacggaaccccg

SEQ ID NO: 312327 - DNA, 557 bp, Homo sapiens
  misc_feature: GZ8MTXP02H8X0W.11.28.C06.1.454.CMB.2.raw
tcagcgagagataccacgaccggtgctcgatttagagctcacgtattggggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataagtggaacactacttgagttggttcagcagagcaggcaatctcagcgacctaatttataaggtttctaggcggtactcgtcggggtcccagaccagtattcaggcggcaggtgggtcgaggcgctgtactttcacactagagatcgaggcgaggggtggaggctaggagtagtgggttcggggtttatacgttagcagtgacgtagggtacgaggtcggtcgtccgttcgcgtcgcgtaggtacggcgggaacgggaccgagggtaggagtaacgtacgaaaaccggtagtacggtcggacttacgaccg

SEQ ID NO: 312328 - DNA, 548 bp, Homo sapiens
  misc_feature: GZ8MTXP02ILV01.11.28.C06.1.454.CMB.2.raw
  modified_base (212)..(212): a, c, t, g, unknown or other
  misc_feature (212)..(212): n is a, c, g, or t
  modified_base (275)..(275): a, c, t, g, unknown or other
  misc_feature (275)..(275): n is a, c, g, or t
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
  modified_base (411)..(411): a, c, t, g, unknown or other
  misc_feature (411)..(411): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctggtcccagtgtccagtggggatgtgtgttgactcagtctccactctccctgcccgtcacccttggacagccgctccatctccngcaggtcaagtcagagcctcgtcaacgataaagtggaacacctacttgagttggttcagcagnggccaggccaatctacaaagccgactaaatttagtaagtttcaggcggactcgtcggggtacccaggaccagattcgagcgcagtggggtcaggcgctagntttcgaacntgacaatcgagacgaggtggaaggtntagagtgtaggttaggtttatacgtgatagtagacgtaggtactagtcgtcgtcgtcgcgtcgacgtaggtccgggaggaacggacgtaacggtagaacgaacgtaacgaaacgtacgtacggtcgtacgtacgacc

SEQ ID NO: 312329 - DNA, 616 bp, Homo sapiens
  misc_feature: GZ8MTXP02G02HN.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtccagtgtccagtggggatgttgtgttgactcagtctccactctccctgcccgtcacccttggacagccggcctccatctcctgcaggtcaagtcagacgcctcgttcacgataagtaggaacacctactgtagttggttcagcagaggccaggccaatctaccgaaggcgaccttaatttagtaaggtttctagggcggtactcgtcggggtaccccagaccagtacttcgaacggtcggcaagggtcggggtacgagggccgcttaggtactttacgaactacgtagaagaaagtcgaaggacgagggggtaggaggcgtaaggaagtagttggggttaccggggttttaaattcggtagacgtaggtgacgtagggtactagggtcggtcggtccgttcgcgtcgtacgagttcgggacgggaacgggtacgaagggtaggaagaagtaacgaaaacggacttaggacggtcacgtaaccg

SEQ ID NO: 312330 - DNA, 547 bp, Homo sapiens
  misc_feature: GZ8MTXP02IF4CK.11.28.C06.1.454.CMB.2.raw
  modified_base (506)..(506): a, c, t, g, unknown or other
  misc_feature (506)..(506): n is a, c, g, or t
tcagcgagagataccacgaccggtgctcgatttagagctcacgtattgggtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgcaggctccagggcaggggctggaatggatttcatacattggtgaaagtggcagtcccatataccacgcagactctgtgacggcggttcaccatctccagggacaactaccaaaactcactatatctaggaatgactagcctgagctcgagacacggtctttatactgtcgcgaccgcccgcgatacgcacgcatcactctaacggtcggggccgacgggggccctcgggtccacccgtcctcctctcgcctcccaccgaacggccctacgtccggttcctccccgtggcccncccgtcgcctccgaaggcgccaccctaccgacgcgcgaccg

SEQ ID NO: 312331 - DNA, 544 bp, Homo sapiens
  misc_feature: GZ8MTXP02HIMK2.11.28.C06.1.454.CMB.2.raw
  modified_base (383)..(383): a, c, t, g, unknown or other
  misc_feature (383)..(383): n is a, c, g, or t
  modified_base (439)..(439): a, c, t, g, unknown or other
  misc_feature (439)..(439): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctgttcacgataatggaacacctacttgagttggttcagcagagcaggcaatctcaagcgactaatttataaggtttctaggcggactctggggtccagaccagatcagcggcagtgggtcaggcgctgactttcgacactgaagtaanacgagacgaggtggaggagtagaagagtaggtacgggtttaagttactagcagtgngaggtagtagtggtggtcgtcgtcgtcgtcgtacgttcggtacgggaacgggaccgaacggtaggagaacgtagaaacgtaacgtaggtaggtcgtacggtaccg

SEQ ID NO: 312332 - DNA, 557 bp, Homo sapiens
  misc_feature: GZ8MTXP02FTIYC.11.28.C06.1.454.CMB.2.raw
  modified_base (325)..(325): a, c, t, g, unknown or other
  misc_feature (325)..(325): n is a, c, g, or t
  modified_base (495)..(495): a, c, t, g, unknown or other
  misc_feature (495)..(495): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctacttgagttggttcagcagaggccagccaatctcaaggcacctaattataggtttcaggcggactcgnggggtccagaccagatcagcggcaggtggggtcaggcgctgtatttcgactacgtgaagaatcgagcgagggtggaggacgtaggaaagtgttaggttacgggggtttattaacgtgtcagttcgacgtaggggtacaggttgtcggtccttcgctcgcgtagttcgggngggaacggggaccgaaagggtggaagtaacgtaacgaaaacgtagtcggtaggctacggacc

SEQ ID NO: 312333 - DNA, 596 bp, Homo sapiens
  misc_feature: GZ8MTXP02JN3I9.11.28.C06.1.454.CMB.2.raw
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (495)..(495): a, c, t, g, unknown or other
  misc_feature (495)..(495): n is a, c, g, or t
  modified_base (518)..(518): a, c, t, g, unknown or other
  misc_feature (518)..(518): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagcccggcctccatctcctgcaggtcaagtcagacgcctcgttcacgataagtgggaacacctacttgagttggttcagcagagcaggcaatctcaggcnctaatttanagtttnaggcggactcgtcggggtacccagtacccagtattacgaggtcggcagggtggggtacagggtcgtactgtactttccagtaactgaaagaacttcgaggacgagggggtaggagggactaggaaagagtttcggggttacggggttttaatcgttgactaaggttgacgtaggggttaacnggtcgtcggtaccgtcgcgtcgngtacgggtcgggacgggacggacgtaagggtacggagtaacgtaacgaaaacggtacgtaggacgtaccgtacggacc

SEQ ID NO: 312334 - DNA, 541 bp, Homo sapiens
  misc_feature: GZ8MTXP02GQYCS.11.28.C06.1.454.CMB.2.raw
  modified_base (513)..(513): a, c, t, g, unknown or other
  misc_feature (513)..(513): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatctcctgcaggtcaagtcagagcctcgttcacgataagtggaacacctattgagttggttcagcagaggccaggcaatctcaagcacctaatttataaggtttcaggcggtactcgtggggtccagaccagattcgaggcgcaggtggggtcagggcgtctgactttcaactacgtgaaagaatcgaagcgaaggggtcggaggactaggaaagtagttagggttacggggtttaattacgtgactagtgacgtaggtacagtcggtgtccttgcgtcgctgtcggcggaggaccgaggtgganaagtacgaaaacgtcgtggacgctgacc

SEQ ID NO: 312335 - DNA, 673 bp, Homo sapiens
  misc_feature: GZ8MTXP02JNFQD.11.28.C06.1.454.CMB.2.raw
  modified_base (214)..(214): a, c, t, g, unknown or other
  misc_feature (214)..(214): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgctccatctccngcaggtcaagtcagacgtcctcgttcaacgtataagtcgggaactaccttacgtgtagttcggttcaggtcaggacggccaggccctaagtcctaccgaaggcctaccttaagtttacgtaaggtttcgaaggccggtactcggtcggggtaccccaggtacccgagtacgttcgaacggtccgtacgtaggtcgggtcaacgggtcctacgttgtaacctttcgaacgtacgtaggtaaacgacgtccgggagtacgggggtgacgtccgtaaggaacgttacgttacggggttacggttactaacgtggaaccgtagtccggtaagtacggtacgaggttcgtacggtaccgttcgcgttacgtacgtacggttccggggacggtacggtaccgtaagggtcgaacgtactaaccggaaaacgttccgtaggtacgaccgtacggtacccttaaacg

SEQ ID NO: 312336 - DNA, 520 bp, Homo sapiens
  misc_feature: GZ8MTXP02FJQP0.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggctccatctcctgcaggtcaagtcagagcctcgttcacgataatgggaacacctacttgagttggtttcagcagaggccaggccaaatctccaaaggcgcctaatttataaggtttctaggcggggactctggggtccccagaccagatcagcggcagtgggtcaggcgctgatttcacactgagaatcagcgagggtggaggctgaaagatgtcggggtttattactgcatgcagggtacagtgtggcctttgctcgcagttcgggcggacggggaccgaaggtggaagaagtacaaacgaactgtacggctgacc

SEQ ID NO: 312337 - DNA, 558 bp, Homo sapiens
  misc_feature: GZ8MTXP02JNQQX.11.28.C06.1.454.CMB.2.raw
  modified_base (500)..(500): a, c, t, g, unknown or other
  misc_feature (500)..(500): n is a, c, g, or t
tcagcgagagataccacgaccggtgctcgatttagagctcacgtattgggtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgccaggctccagggcaggggctggaatggatttcatacattggtgaaagtggcagtcccatataccacgcagactctgtgaaggccggttcacatctcaggacaactaccaaaactcactatatctagaaatgactagcctgagactcgaggacacgtccgtttatactgtgcgaccgcccgcgatagcagcatcatctacgtggggaccacggggaccctggtccacccgtcctcctcgtcgcctacccgaccgaacgggccctacgtcccggttccttcccccgnggtcccgcccgtcgcccgtaccgaacggacgcccaccgtaccgacgacgaccaaccgg

SEQ ID NO: 312338 - DNA, 609 bp, Homo sapiens
  misc_feature: GZ8MTXP02JK6FL.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatcctcctgcaggtcaagtcagacgcctcgttcacgataatagggaacacctatgagttgttcagcagacgccaggccaatctaccgaggctaccttaatttataaggtttcaggcggtactcgtcggggtcccagaccagtattcgaggtcggacgaggtggggtcagggcgtctgtaactttcaacactgaagaatcgagcgaggggtggaggcgtaggaaagtagttcggggttacggggttttaatacgttgactagttcgacggtaagggtactaggtggtcggtccgttcgcgtaccgtcgtaaggttccggggacgggtaacggggaacccgtaaggggtacggaacgaacgtaaacgaaaaccggtacgtaggttcggaccgttcgaaccg

SEQ ID NO: 312339 - DNA, 575 bp, Homo sapiens
  misc_feature: GZ8MTXP02INYBS.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgctcgttcacgataagtggaactacctactgtagttggttcagcaggacgccaggccaatctaccaaggcacttaatttagtaaggtttcaggcggtactcgtcggggtccagaccagattcgagcggcagggtcggggtcagggcgctagtactttcactacgtagaagaactcgaagcgaggggtggaggctagaagagttggttacggggtttaatacgttgacagtgacgtaggggtaactggttcgtggtcctggcctcgacgtaggtaccggacggggtaacgggaccgaaggggtcggaagtaacgtacgaaaacgtacgtggtcggactcggacc

SEQ ID NO: 312340 - DNA, 545 bp, Homo sapiens
  misc_feature: GZ8MTXP02HFQF9.11.28.C06.1.454.CMB.2.raw
  modified_base (288)..(288): a, c, t, g, unknown or other
  misc_feature (288)..(288): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatctcctgcaggtacaagtcagacgccttcgttcacgataagtggaacactacttgattggttcagcagagcagcaatcncaagcgactaattataaggtttctaggcgtactcgtcgggtaccagaccagacttcgagcgacgagtggggacaggcgctgtattcacatgaataananagagaggaggagagagagtagtaggttaggttagtagtgtgagtagagaggtagtagtcgtcgtcgtcgtcgtcgtacgtacggtacgggacgggaacggaacggtaacggtaagaagaacgtaaacgtaaaacgtacgtagtacggtacgtacgacg

SEQ ID NO: 312341 - DNA, 591 bp, Homo sapiens
  misc_feature: GZ8MTXP02FUATA.11.28.C06.1.454.CMB.2.raw
  modified_base (247)..(247): a, c, t, g, unknown or other
  misc_feature (247)..(247): n is a, c, g, or t
  modified_base (496)..(496): a, c, t, g, unknown or other
  misc_feature (496)..(496): n is a, c, g, or t
  modified_base (584)..(584): a, c, t, g, unknown or other
  misc_feature (584)..(584): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctcatcctcctgcaggtcaagtcagagcctgttcacgataagnggaacacctacttggagtttggttcagcaggaggccaggccaatcctacaaggctacctaaatttataaggtttcaggcgggtactcgtcggggtaccagacagtatcgagcggcagggtcggggtacagggcgtctgtatttacactacgtgaagaaatcgaggcgtaagggggtggaacgggtcgtaggaaagagttacggggttacggggttttaatacgtggactagtcggacgtaggggtaacngggttaggtcggtccgttcgcgttcgacgtaggttccgggagggacggtaacgagggtcgaagaatacgaaaacgtacgtgtacggcncgtaccg

SEQ ID NO: 312342 - DNA, 609 bp, Homo sapiens
  misc_feature: GZ8MTXP02ICLXT.11.28.C06.1.454.CMB.2.raw
  modified_base (283)..(283): a, c, t, g, unknown or other
  misc_feature (283)..(283): n is a, c, g, or t
  modified_base (428)..(428): a, c, t, g, unknown or other
  misc_feature (428)..(428): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgccttcgtcaacgataagtgggaacacctacttgagttggttcagcaaggnggccaggccaaatctacccgaaggccgtaccttaaaattttagttaaacgggtttctaacgggcgggtaacctcgtcggggtacccaaggaccagtattcaggcggcaggtcggggtcaggggcgtctgtatttcacacgtgaanaatcgagcgtaggggtggaggcgtagaaagtacgttgggtttacgggtttattcgtgacgtatggacgagggtactaggttcggtcggtccgttcgcttcggctaacggttccggggacggaacggggaccgaagggtcggaagaacgtaacgaaaacgtacgtggtacggcgacgtaccg

SEQ ID NO: 312343 - DNA, 585 bp, Homo sapiens
  misc_feature: GZ8MTXP02INFI2.11.28.C06.1.454.CMB.2.raw
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (347)..(347): a, c, t, g, unknown or other
  misc_feature (347)..(347): n is a, c, g, or t
  modified_base (362)..(362): a, c, t, g, unknown or other
  misc_feature (362)..(362): n is a, c, g, or t
  modified_base (386)..(386): a, c, t, g, unknown or other
  misc_feature (386)..(386): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacagccggcctccatcctcctgcaggtcaagtcagagccttcgttcaacgtataaagtgggaaactacctactgtagttgttcagcagngcagcaatcncagcactaattataagtttcaggcgactcgtgggccagccagtatcagcgnaggtgggtcaggccngtgtatttccactactagaaatancgagcgagggtaggcggatagaagtagttggttacggggtttttatacgtgacgtagagcggtaagggtactagggttgttcggggttcccttcggccgttcgacgttacggttcccggggacggggtacgggaaccgtaaaggggtcggaaaggtaacgtaacgaaaaccggtaacgtcggtacggtactcgaacccg

SEQ ID NO: 312344 - DNA, 587 bp, Homo sapiens
  misc_feature: GZ8MTXP02GSGOU.11.28.C06.1.454.CMB.2.raw
  modified_base (400)..(400): a, c, t, g, unknown or other
  misc_feature (400)..(400): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatcctcctgcaggtcaagtcagacgcctcgttcacgataagtggaacacctacttgagttggttcagcagaggccaggccaatctaccaaggctacctaatttataaggtttctaggcggtactcgtggggtcccagaccagtattcgaggcggcaggtggggtcaggcgctgtactttcactacgtgaanaatcgagcgaggggtcggaggctaggaagtagttagggttcggggtttaatacgttgactagttgacgtagggtacagggttcggtacggtccgttcgcgttcggcgtagttccggggacgggtacggggaccgtaagggtaggaacgtaacgtacgaaaacgtacgtggtacggactacggacccg

SEQ ID NO: 312345 - DNA, 651 bp, Homo sapiens
  misc_feature: GZ8MTXP02IRYX2.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctcgcccgtcacccttggacacgccggcctccatcctcctgcaggtcaagtcagacgccctcgttacaacgtataagtggaacctaccttacttgtagtttggttcagcaaggacggccacggacctaatctaccgaaggctaccttaaatttagtaacggtttcgaggcggtactcgtcggggtacccagaccagacttcgagcggcagggtgggtcagggcgtctagtactttcactacgtgaagaactcgagcgagggtggaggtcgtagaagtgttagggttacgggtttaatacggtcgtacgtaggtacggtacgtagggtacgtaggttcggtccggttacccgttacgccgttcggtacgtacggttcccggggacggggtaaaccgggtacgtaaacggggtcggaaaagtaacgtaaaccggtaaaaccggtacgttcggtaccggtactcggtaaacccg

SEQ ID NO: 312346 - DNA, 576 bp, Homo sapiens
  misc_feature: GZ8MTXP02FVPUU.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctgttcacgataagtggaacacctattgagtttggttcagcagacggccaggccaatctaccaaggctacctaaatttataaggtttcaggcgggtactcgtggggtcccagaccagattcagcgacaggtgggtcagggcgtctgtaatttcactacgtgaagaatcgaagcgagggggtggaggtcgtaggaaagtgttagggttacggggtttattacgtagctagtgacgagggtacaggttggtcgaccttcgactcgcgtacgttcgggacgggtaacgggaccgtaaaggggtgaaagtaacgtaacgaaaacgtacgtggtcggacgtagacccg

SEQ ID NO: 312347 - DNA, 577 bp, Homo sapiens
  misc_feature: GZ8MTXP02JEL9W.11.28.C06.1.454.CMB.2.raw
  modified_base (231)..(231): a, c, t, g, unknown or other
  misc_feature (231)..(231): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagngcctcgttcacgataagtggaacacctactgtagttggttcagcaggacggccaggccaatcctaccgaaggcgtacctaaatttagtaaggtttcaggcggactcgtggggtccagaccagatcagcgcaggtggtcaggcgctgtatttcacactgaagatcgagcgagggtaggaggacgtagaagtagttggttacggggtttattacgtgctagttcgcgtaagggtacgtaggtcggttcggtccgttcgtcctcggacgtacgttccgggacggggtacgggtaaccggaagggttacggagtaacgaacgaaaacgtacgtggtacggcgtcggaccc

SEQ ID NO: 312348 - DNA, 540 bp, Homo sapiens
  misc_feature: GZ8MTXP02FHU7J.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctacttgagttggttcagcagaggccaggccaatctccaaggcgacctaatttataaggtttcaggcgggactcgtggggtcccagaccagatcaacggcagtgggtcagggcgctgatttcacactgagaatcagcaggggtggaggctagaagagtggttacggggtttatacgtgcagtgcgagggtacagtggtgtcctcgtctcggctagttcggcggacggggaaccgaacgggtggaagagtaaccgaaaacgaacgtcggtcggacgtcgcaacccg

SEQ ID NO: 312349 - DNA, 537 bp, Homo sapiens
  misc_feature: GZ8MTXP02IRQNV.11.28.C06.1.454.CMB.2.raw
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataagtggaacacctactgagttgttcagcagagcagcaatctcaggcactaattataggtttcaggcggtactcgtggggtccagaccagatcgagcgcagtcgggtcaggcntgattcacactganatcgagcgagggtggagcgtagagtagttggttacgggtttaatacgtgactagtgacgaagggtacaggtcggtagtccgtttcgcgtcgcgtagttcgggacgggtaacgggaccgaaagggtgaagaacgtacgaaaacgtcgtagtcgggacttacgaacc

SEQ ID NO: 312350 - DNA, 650 bp, Homo sapiens
  misc_feature: GZ8MTXP02ISMNP.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtccagtgtccaggtggggatgttgtgttgactcagtctccactcctccctcgcccgtcacccgttggacacggcccggcctccattcctcctgcaggtcaagtcagacgtccttcgtacaacgataagtcgggaactaccttacgttgtaggtttggttacagcgaggacggaccacggccaatccgtaccgaaggtcctaccttaaatttagtaacggtttcgaagggcggtactcgtcggggtacccagaccagtacttcgacggcggtacgtagggtggggtacaggggctcgttagtactttccgactacgtgaaagtactcgaggtcgggaggggtggaggtacgtaggaaaggtcggtttagggttacggggttttaatacgtgacgtagtcgaggtacgggtactaggttcggtcggttccgtcgcgtcgtacgtcgggtcgggacggggacggaacgtagggtaggaacgtaacgtaaccgtaaaggtacgtgggcgtacggtctaaccg

SEQ ID NO: 312351 - DNA, 582 bp, Homo sapiens
  misc_feature: GZ8MTXP02JF74O.11.28.C06.1.454.CMB.2.raw
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacagcccggcctccatcctcctgcaggtcaagtcagacgcctcgttcaacgataagtgggaaacacctacttgagttggttcagcaggacggccaggccaatctaccgaaggccgaccttaatttaagtaaggtttctagggcggtactcgtggggtcccagaccagatcagcgnaggtgggcagggcnctgtatttcanactganaatcgagcgagggtgaggctagagtagttggttacggggtttaatacgtgactagtgacgtagggtacagggttcgtcggtccgtcgcgtcgacgtaggttcggggacggtaacggggacctaacggggtggaacgtaacgtaacgaaaacggtacgtggtacggtcgtacggtaaccg

SEQ ID NO: 312352 - DNA, 585 bp, Homo sapiens
  misc_feature: GZ8MTXP02GZUBU.11.28.C06.1.454.CMB.2.raw
  modified_base (382)..(382): a, c, t, g, unknown or other
  misc_feature (382)..(382): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagacgcctcgttcacgataagtggaacactacttgagttggttcagcagacggccaggccaatctaccaaggcgactaattattaaggtttctagggcggtactcgtcggggtcccagaccagtatcgagcggcgaggtcggggtcagggccgntgtactttcactacgtagaagatcgaagcgaggggtggaggctaggaagtagttgggttacggggtttatacgtgactagtgcgtaagggtacgtggtcggtcggtccgttcggacttcggacgtaggttccggggacggtaacgggaccgaagggtcggaagtaacgtaacgaaaacggtacgtggtacggcgtacggaccg

SEQ ID NO: 312353 - DNA, 569 bp, Homo sapiens
  misc_feature: GZ8MTXP02JBHJ9.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagcccggcctccatctcctgcaggtcaagtcagacgccttgttacacgtaataagtgggaaactacctactgtagttgttcagcagacggccaggccaatctacgaaggcgtacctaatttagtaaggtttcaggcggtactcggtcgggtccagaccagtactcgagcggcaggtcggggtcacgggctacgtgtactttaccactacgtgaaagagtacgagcgtaggggtcggaggtctaggaaagtgttgggttacgggtttatacgtgacagtcgacgtagggtactggtgcgtcgtcgctcgactggtccggaggacggacgtaggtggaataacgtaacgaaccgtacgtgacggctcgaaccg

SEQ ID NO: 312354 - DNA, 581 bp, Homo sapiens
  misc_feature: GZ8MTXP02HBIKP.11.28.C06.1.454.CMB.2.raw
  modified_base (300)..(300): a, c, t, g, unknown or other
  misc_feature (300)..(300): n is a, c, g, or t
  modified_base (425)..(425): a, c, t, g, unknown or other
  misc_feature (425)..(425): n is a, c, g, or t
  modified_base (466)..(466): a, c, t, g, unknown or other
  misc_feature (466)..(466): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatcctcctgcaggtcaagtcagagcctcgttcacgataatggaacacctattgagttggttcagcaggagccaggccaatctccaaggcnctaaatttataaggtttcaggcggactcgtcggggtacccagacccagacttcaggtcggcaggttggggtcagggtcgctgtatttcacatgagatcaggcgaggggtggaggtctagggaagngttaggtcggggtttaatacgtgctagtgacgtgggtaacnggttacggtcgtacctttcggccttcggcgtacggttcgggaccggggaacggtaccgtaagggggcgaagtaacgtaaccgaaaacggtacgtggtcggggacttacgggaacc

SEQ ID NO: 312355 - DNA, 608 bp, Homo sapiens
  misc_feature: GZ8MTXP02GZ0OJ.11.28.C06.1.454.CMB.2.raw
  modified_base (416)..(416): a, c, t, g, unknown or other
  misc_feature (416)..(416): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccgcctccatcctcctgcaggtcaagtcagagcctcgttcacgataagtgggaaacacctacttgagttggttcagcagacggccaggccaatcctaccgaaaggccgaccttaaattttagttaaacggtttcgtagggcggtactcgtggggtccccagaccagtacttcaggcgcgtagggtcggggtcgagggcgtctgtatttcactacngaagatcagcgagggtggagcgtagaagagtgggttcggggtttattacgtgctagtgacggtaaggtacgtaggttggtgggtcccgtttcggcgtccgtcggtaggttccggggacggggaacggggtaccgaaaggggtggaagtaacgttaacgaaaccggtaaacgtggtacggccttaggaacccg

SEQ ID NO: 312356 - DNA, 591 bp, Homo sapiens
  misc_feature: GZ8MTXP02HJHCG.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctcatctcctgcaggtcaagtcagacgcctcgttcacgtataagtggaacactacttgagttggttcagcaggagccaggccaatctaccgaaggcgaccttaatttagtaaggtttcaggcggtactcgtcggggtcccagacccagtattcgaggcggcaggtggggtcagggctcgtagtactttacacacgtgaagaatcgagcgaggggtaggaggcgtagaagtaggttaggtttacggggtttattacgttgacgtagtgacgtagggtacaggttggtcggtccgttcgctcggacgtacggttcgggacgggtaacggaccggaagggttggaacgtaacgtaacgaaaacggtacgtaggtcggaccgtacgaaccg

SEQ ID NO: 312357 - DNA, 577 bp, Homo sapiens
  misc_feature: GZ8MTXP02GL0F4.11.28.C06.1.454.CMB.2.raw
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (457)..(457): a, c, t, g, unknown or other
  misc_feature (457)..(457): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgccccgtcacccttggacagccggcctccatcctcctgcaggtcaagtcagacgtcctgttacacgataagtcggaaacacctacttgtagttggttcagcagacggccaggccaatccacaaggtcaccttaaatttagtaaggtttcaggcggtactcgtcggggtccagaccagtatcgagcgngaggtcgggnaggcnctgtacttcactacgtgaanatcgagngagggtcggagcgtaggaaagtgttgggttacgggtttattacgngacgtagtgacgtagggtacaggtgtcggtcctcgcgtcgcgtaggtacgggacgggaacgggaaccgtaagggtcggaagtaacgtaacgaaacgtacggtggtacggcgtacgtaccg

SEQ ID NO: 312358 - DNA, 650 bp, Homo sapiens
  misc_feature: GZ8MTXP02HUR4W.11.28.C06.1.454.CMB.2.raw
  modified_base (231)..(231): a, c, t, g, unknown or other
  misc_feature (231)..(231): n is a, c, g, or t
  modified_base (277)..(277): a, c, t, g, unknown or other
  misc_feature (277)..(277): n is a, c, g, or t
  modified_base (381)..(381): a, c, t, g, unknown or other
  misc_feature (381)..(381): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagngcctgttcacgataagtggaacacctattgagtttggttcagcagnggccaggccaatctcaaggctacttaaatttgtaaggtttcaggcggtatcgtcggggccagacctagtacttcgaggtcgacgagggttcggggtcagggccncgttagtactttcacctacgtgtaagactcgagcgtaaggggtggaaggcgtaggtaagtaggttcgggtttaccgggggttttaattaccgtggacgtagtacggtaccggtaaggggttacgtaagggttcggttcgggtcccgtttccgtccgttacggtccgttacgggttaccggggacggggtaacggggaaccgtaaacgggggttaggaggtaaaccgtaacgaaaaccggtaaacgttgggtaaccgcggttacgaaccg

SEQ ID NO: 312359 - DNA, 532 bp, Homo sapiens
  misc_feature: GZ8MTXP02GNND0.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatggaacacctacttgagttggttcagcagaggccaggccaatctccaaggcacctaatttataaggtttctaggcggactcgtggggtcccagaccagattcagcggcaggtgggtcaggcgctgatttcacactgagatcagcgagggtggaggctagaagagtggttcggggtttattacgtgcagtgacgagggtacaggtgtggtccttcgctcgcgagttcgggacggacgggaccgaagggtggagaagtacgaaaacggtactggtacggctcggacc

SEQ ID NO: 312360 - DNA, 531 bp, Homo sapiens
  misc_feature: GZ8MTXP02FGTOX.11.28.C06.1.454.CMB.2.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (329)..(329): a, c, t, g, unknown or other
  misc_feature (329)..(329): n is a, c, g, or t
  modified_base (344)..(344): a, c, t, g, unknown or other
  misc_feature (344)..(344): n is a, c, g, or t
  modified_base (368)..(368): a, c, t, g, unknown or other
  misc_feature (368)..(368): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcaccttgacagccggctccatcncctgcaggtcaagtcagngcctcgttcacgataatgggaacacctacttgagttggttcagcagaggccaggccaatctaccaaggcgcctaatttataaggtttcaggcgggactcgnggggtcccagacccngatcgagcggcaggtggtcaggcntgatttcacactgagaatcagcgagggtgaggctgaagtgtggttcggggtttattacgtgcatgcgaggtacagtcgtggccttcgctcgcgtagttcggacgggacgggaccgaaaggggtggaacgaactacgaaaacgaacgtggtcggctcggacccg

SEQ ID NO: 312361 - DNA, 550 bp, Homo sapiens
  misc_feature: GZ8MTXP02H0UFR.11.28.C06.1.454.CMB.2.raw
  modified_base (540)..(540): a, c, t, g, unknown or other
  misc_feature (540)..(540): n is a, c, g, or t
tcagcgagagataccacgaccggtgctcgatttagagctcacgtattgggtttggggctgatcaggactccctcagttcaccttctcacaatgaggctccctgctcagctcctggggctgctaatgctctgggtcccagtgtccagtggggatgttgtgttgactcagtctccactctccctgcccgtcacccttggacagccggcctcatcgtcctgcaggtcaagtcagacgcctcgttcaacgataatgggaacacctacttgagttggttcagcagaggccaggccaatcctaccaaggccgctaatttataaggtttctagggcggactcgtggggtcccaggtaccagtattcgagcggcagtcggggtcagggcgctgatttcgacactgagaatcgagtcgaggggtcggaggctaggagtacgtggttacggggtttattaacgtgctagtgacgagggtactaggtgtcggtcttcgacttcgctagtcggtggaacggtccgaaggtggagaataccgaaacgttacgngtcgctacgc

SEQ ID NO: 312362 - DNA, 579 bp, Homo sapiens
  misc_feature: GZ8MTXP02FWUK4.11.28.C06.1.454.CMB.2.raw
  modified_base (295)..(295): a, c, t, g, unknown or other
  misc_feature (295)..(295): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatctcctgcaggtcaagtcagacgcctcgttcacgataagtgggaacacctacttgagttggttcagcagaggccaggccaatcncaaggcgacttaatttagtaaggtttcgaggcgggactcgtcggggtacccagaccagtatcgaggcggcagggtggggtcagggcgctgtatttcaactacgtagagaatcgaggcggaggggtggacggtcgtaggaaaggtgttaggggttacggggtttattacgtgacgtagtggacgtagggtactagggttggtcggtccgttcgcgtccggcgtagttcggggacgggacggaccgaagggtgagaacgtacgaaacgacgtggacgcgtacgacc

SEQ ID NO: 312363 - DNA, 556 bp, Homo sapiens
  misc_feature: GZ8MTXP02JCL5A.11.28.C06.1.454.CMB.2.raw
  modified_base (275)..(275): a, c, t, g, unknown or other
  misc_feature (275)..(275): n is a, c, g, or t
  modified_base (390)..(390): a, c, t, g, unknown or other
  misc_feature (390)..(390): n is a, c, g, or t
  modified_base (480)..(480): a, c, t, g, unknown or other
  misc_feature (480)..(480): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacacggccgcctcatctcctgcaggtcaagtcagcgcctgtcacgataagtggaacacctatgagttggttcagcagngcagcaatctcagcactaagtttataaggtttcaggcggactcgtggggtacccagaccagtattcagtcggcgaggtggggtacagggcgctgtactttcactactgaactaancgaggcgagggtggagcgtaggaagtagttggttacgggtttatacgtgactagtcgagtaaggtacgtaggtgtcggtcttcgctcggngtacgttcgggacgggaacgggaccgtaagggtaggaacgtaagtaaccgaaaagacgtggcgtacgtacgaaccg

SEQ ID NO: 312364 - DNA, 582 bp, Homo sapiens
  misc_feature: GZ8MTXP02IRF0V.11.28.C06.1.454.CMB.2.raw
  modified_base (380)..(380): a, c, t, g, unknown or other
  misc_feature (380)..(380): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtgggatgttgtgttgactcagtctccactctccctgccccgtcacccttggacagccggcctccatctcctgcaggtcaagtcagagcctcgttcacgataagtggaacacctactgagttggttcagcagcgccaggccaatctaccaaggcgaccttaaatttagtaaggtttcgtagggcggtactcgtcggggtcccagaccagtatcgagcggcgagtgggtcaggcgtntgtatttcactacgtgaaagaatcgaggcgaggggtggaggacgtagaaagagttagggttacggggtttaaattcgtgtacgtagtcgacgtaagggtacgtggtggtcggtccgtttcgccgtacgcgtaggttcggggacggtacgggaccgaagggtggaagaacgtaaacgaaacgtacgtggtacggctacgaccg

SEQ ID NO: 312365 - DNA, 552 bp, Homo sapiens
  misc_feature: GZ8MTXP02HSENJ.11.28.C06.1.454.CMB.2.raw
  modified_base (287)..(287): a, c, t, g, unknown or other
  misc_feature (287)..(287): n is a, c, g, or t
  modified_base (455)..(455): a, c, t, g, unknown or other
  misc_feature (455)..(455): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatcctcctgcaggtcaagtcagagcctcgttcacgataatggaacacctatgagttggttcagcagagcaggcaatcncaaggcaccttaatttataaggtttctagggcggtactcgtcggggtccagacccagattcagcggcaggtgggtcaggcgcgttgactttacactactgagaatcaggcgagggggtggaggtcgtaggaagtagttggttacggggtttattcgttagctagtcgngtaggtacgaggtgtcggtcttcgctcgcgtagttcggacgggacggaacgtagggtggaagtaacgtacgaaaacgtacgtgtacggtcgtgaccg

SEQ ID NO: 312366 - DNA, 582 bp, Homo sapiens
  misc_feature: GZ8MTXP02GSYPX.11.28.C06.1.454.CMB.2.raw
  modified_base (300)..(300): a, c, t, g, unknown or other
  misc_feature (300)..(300): n is a, c, g, or t
tcagcgagagataccacgaccggtgctcgatttagagctcacgtattgggtttggggcgtgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctcctgcaggtcaagtcagagcctgttcaacgataagtgggaacacctacttgagttggttcagcagaggccaggccaatctcaaggcncctaaatttgtaagtttctaggcggtactcgtggggtcccagaccagattcagcggcaggttggggcaggcgtctgatttcacactgagaatcgagacgaggggtggaggcgtagaaggagttacgggtttacggggtttaattaccgtttgagttggacgtaagggtacgtaggttggtcgggtccttcgtcgtccgtacgtacggttcggggaccggtaaggggaaccgtaagggtacggagaactaacgaaaacgtaagtcggtagctacgactaaccg

SEQ ID NO: 312367 - DNA, 593 bp, Homo sapiens
  misc_feature: GZ8MTXP02H4CM5.11.28.C06.1.454.CMB.2.raw
  modified_base (463)..(463): a, c, t, g, unknown or other
  misc_feature (463)..(463): n is a, c, g, or t
  modified_base (492)..(492): a, c, t, g, unknown or other
  misc_feature (492)..(492): n is a, c, g, or t
  modified_base (587)..(587): a, c, t, g, unknown or other
  misc_feature (587)..(587): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccacttctccctgccccgtcacccttggacagccggcctccatctcctgcaggtcaagtcagacgccttcgttcaacgataagtgggaaacctacctacttggtagtttggttcagcaggacggccacggaccaatcctaccgaaggccgtacctttaaattttaagtaacggttttcgagggcggtactcggtcggggtaccaggacccagacttcgaggtcggacgtagggtcggggtcgagggccgtctaggtactttcaacacgtagagaatcgagcgtaggggtgagntagagtgttgggttcgggtttatacgtgntagtgacgtaggtactgggtcgtcgtccgttgacgttcgacgtacggttcgggaggtacggacgaggtgacgaataccgaaaagtcgtggcggtnacgacc

SEQ ID NO: 312368 - DNA, 616 bp, Homo sapiens
  misc_feature: GZ8MTXP02JW2J5.11.28.C06.1.454.CMB.2.raw
  modified_base (366)..(366): a, c, t, g, unknown or other
  misc_feature (366)..(366): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagcccgcctccatctcctgcaggtcaagtcagacgcctcgttcaacgataagtgggaacacctacttgagttgttcagcagaggccaggccaatcctaccaaggcaccttaatttataaggtttcgtagggcggtactcgtcggggtcccagaccagattcaggcggnaggtggggtcagggcgctgtactttcacactgaagaatcgagcgaggggtggaggcgtagagtgttgggttacggggtttatacgtgtcagttgacgagggtacgaggttggtacggtccttcggccgtccggtacgtacggttccgggggacggggaacggggtaaccgtaacgggggtaggtaacggtaaacgtaaccggtaaaaaccggtaaaccggttggggtacggtaccgtacgggtaaccccg

SEQ ID NO: 312369 - DNA, 623 bp, Homo sapiens
  misc_feature: GZ8MTXP02HDFVJ.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccgcctccatcctcctgcaggtcaagtcagacgcccttcgttcaacgtataagtgggaaccacctacttgagtttggttcagcagacggccaggccaatcctacgaaggcgtaccttaatttagtaaggtttcgaggcggtactcgtcggggacccagaccagtatcgaggcggcagggtgggcaggcgcgtgtactttcactacgtgaagaatcgagcgaagggggtggaggtcgtaaggaagtagttcggggttacggggttttaatacgttgacgtacggttagacgtaaggggtactgggttcggtcggtccgtttcggcttcggcgttagggttccgggacggggaacgggtacccgaaagggggtcggaaacgtaacgtaaacgaaaaccggtacgtaggacggtactacggaaccc

SEQ ID NO: 312370 - DNA, 591 bp, Homo sapiens
  misc_feature: GZ8MTXP02F6ESV.11.28.C06.1.454.CMB.2.raw
  modified_base (433)..(433): a, c, t, g, unknown or other
  misc_feature (433)..(433): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatcctcctgcaggtcaagtcagacgccctgttacacgataatgggaacacctacttgagttggttcagcagagccaggccaatctccaaggcacctaatttataaggtttcaggcgggtactcgtggggtcccaggaccagattcaggcgcaggtggggtcagggcgtctgtatttcaactacgtagaagtaatcgaggcgaaggggtggaaggctaggaaagngttaggttcggggtttattacgtgctagtgacgtagggtacagtcggtggtcctttcggctcggtcgaggttccggggacgggtaacggggaaccgtaaggggtggaagtaaacgtaccgtaaaaacggtacgtagggttcggaccgttcggaacccg

SEQ ID NO: 312371 - DNA, 560 bp, Homo sapiens
  misc_feature: GZ8MTXP02IIS42.11.28.C06.1.454.CMB.2.raw
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (397)..(397): a, c, t, g, unknown or other
  misc_feature (397)..(397): n is a, c, g, or t
tcagcgagagataccacgaccggtgctcgatttagagctcacgtattggggtttggggctgatcaggactcctcagttcaccttctcacaatgaggctccctgctcagctcctggggctgctaatgctctgggtcccagtgtccagtggggatgttgtgttgactcagtctccactctccctgccccgtcacccgttggacaggccggcctccatcctcctgcaggtcaagtcagagcctcgtcaacgataagtggaactctacttgagttggttacagcagacgccaggccaatctaccaaggctacttaatttagtaggtttcagggcggactcgtcgggtccagcagntcagcgnagtggggtcaggccgctgactttcactactgaagtaacncgagcggaggggtcggagtacgtaggtaagtgttgggtttacgggtttatacgtgtacagtcgacggtaggtatggtcgtcgtcgtcgcgtcgtacgtaggtcgggacggacggacgtaggtgaagtaacgtaacgaaacgtacgtggtacgtactacgaacg

SEQ ID NO: 312372 - DNA, 626 bp, Homo sapiens
  misc_feature: GZ8MTXP02IJ44U.11.28.C06.1.454.CMB.2.raw
  modified_base (198)..(198): a, c, t, g, unknown or other
  misc_feature (198)..(198): n is a, c, g, or t
  modified_base (371)..(371): a, c, t, g, unknown or other
  misc_feature (371)..(371): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtccagtgtccagtggggatgttgtgttgactcagtctccactctccctgcccgtcacccttggacngccggcctccatcctcctgcaggtcaagtcagacgcctcgttcaacgataagtggaactacctattggagttggttcagcaggagccaggcaatctccaagcactattatagttcaggcggactcgtggggtaccagacccagtatcgagcgacaggtggggtcaggcgctgntttacacactgaacgtaagtcaggcgtaagggggtcggaaggtcgtaggaaagtgttagggtttcggggttttaaatacgtggtacctagttacggacgtaacgggttacgtaggttcggtcggttacccgttcgggaccttcggtacccggttaggttaccgggggaccggggaaaggggtacccgtaaaagggggttcgaaaaggttaacgaaccgtaaaacggtaacgttcgggtaacggcttaacggaccc

SEQ ID NO: 312373 - DNA, 698 bp, Homo sapiens
  misc_feature: GZ8MTXP02GNMYF.11.28.C06.1.454.CMB.2.raw
  modified_base (474)..(474): a, c, t, g, unknown or other
  misc_feature (474)..(474): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtcctccactcctccctcgcccgtcacccgttggaccacgccggcctccatctcctgcgaggtacaagtcagacgtccctcgttacaacgaataagtacgggaacctaccttaacgttggtaaggtttggtttacaggcgaacggacggaccccacggacctaaacttcccgtaccgaaacggggccctaaccctttaaaagttttaacggttaaaacgggttttcgtaacggggtaccggggtaacctttccggggtacgggggtaccccaaggtaccccgtagtaacgttcgacgggcggtacgngggttcggggtcgagggtccgtactgtactttacgacctatgaaagactacgaagcggtaaggggtggaggtacgtaaggaagtaggttagggtttacgggtttaatagttgacgtaggtgacggtaggtagcgggttgtcgtaccgttgccgtcgcgtaggtcgggacgggacggtacgaggggtacgagtaacgaaccgaaaggcttggcgtactggaaccc

SEQ ID NO: 312374 - DNA, 628 bp, Homo sapiens
  misc_feature: GZ8MTXP02FT6EL.11.28.C06.1.454.CMB.2.raw
  modified_base (201)..(201): a, c, t, g, unknown or other
  misc_feature (201)..(201): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccgttggacngccggcctccatctcctgcaggtcaagtcagacgtcctcgttcacgataatcgggaacacctattgagttggttcagcaggacggccaggccaatcctaccgaaggtccgtaccttaaagtttaagttaaacgggtttcgaagggccgggtactcgtcggggtcccagacccgagtactcgaggtcggacagggttggggtcaggggcgtcgtagtactttcaaactacgtagaagtaactacgaggacgaagggggtggaaggtctaggaaagtagttgggttaccggggttttaattacggtgactagtggacgtaggggtacgaggttcggtggtccgttcggcgtcgtgtacggttcggggacgggtacgggaccgtaagggtgaagtaacgtacgaaaacggtactggtcggcgtgaacccg

SEQ ID NO: 312375 - DNA, 622 bp, Homo sapiens
  misc_feature: GZ8MTXP02HAW0T.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttgacagccgcctccatctcctgcaggtcaagtcagacgcctcgttcacgataagtgggaacacctacttgagtttggttcagcagacggcaggaccaatcctaccgaaggccgtaccttaaatttagtaaggtttcgtagggcgggtactcgtcggggtacccagacccgagtattcgaggtcggacgagggtggggtcgagggccgtcgtagtactttcaaccgtactaggaataaagtcgaagcggagggggtgggaggcgtaggaagtagttgggttacggggttttaatacgtgcgtagttgcgtagggtactaggttggtcgtccgtttcggctcggacgtaggttcggggacggggaacgggtaaccggaagggtcggaaagtaacgtaacgaaaaccggagttcggaggtcgtacgaacccg

SEQ ID NO: 312376 - DNA, 658 bp, Homo sapiens
  misc_feature: GZ8MTXP02FGLPM.11.28.C06.1.454.CMB.2.raw
  modified_base (214)..(214): a, c, t, g, unknown or other
  misc_feature (214)..(214): n is a, c, g, or t
tcagcgagagataccacgaccggtgctcgatttagagctcacgtattgggtttggggctgatcaggactcctcagttcaccttctcacaatgaggctccctgctcagctccgtggggctgctaatgctctgggtcccagtgtccaggtggggatgttgtgttgactcagtctccactcctccctgcccgtcacccttggacagcccgctcatcncctgcaggtcagtcagagtccctcgttacacgtataagtgggaacacctacttgagttggttcagcagagccagccaatcacaggctactaattataggttcaggcggactcgtgggtcccagaccagtatcgagcggcagggttgggcaggcgcgttgtactttacactacgtaggaagtaaagtccgaaggcgggtaagggggaggggaggtacgtagggaaaagtggtttacggggttaccgggggttttaattacccgtagtacgtacggttaggaccggtaaagggttacgtagggttcgggttccggtccgtttcggacgtcggtacccgtaggtttcccgggggaacgggggtaaaccgggaaccgggtaaagggggtcggaacggaaacgtaaccggaaaaaccgtacggttaggtacggccgtcggtaaaccccg

SEQ ID NO: 312377 - DNA, 645 bp, Homo sapiens
  misc_feature: GZ8MTXP02GLKTO.11.28.C06.1.454.CMB.2.raw
  modified_base (320)..(320): a, c, t, g, unknown or other
  misc_feature (320)..(320): n is a, c, g, or t
  modified_base (418)..(418): a, c, t, g, unknown or other
  misc_feature (418)..(418): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacagccgcctccatctcctgcaggtcaagtcagacgtccctcgttacacgtaataagtagggaacacctactgagttgttcagcagaggcagcaatcacaaggcactaatttagtaacgtttnaggcggactacgtggggtacccagaccagtacttcgacggcgacgaaggtggggtacagggtacgccgttagtactttcaactactagaaacgtaaanacgacgacggagggtagggacggtacggtaagtaagtaggttagggtttacggggtttaacgttacgtagtagtacgtaggtacggtaacggtacggtacggtacggttcggtccgtcgtacgtacggtacgtacggtacgggtacggggaacgggaaccggtaacgggtaacggaacggtaaacgtaaacgtaaaacgtaacggtacggtacggtacgtacgtacg

SEQ ID NO: 312378 - DNA, 698 bp, Homo sapiens
  misc_feature: GZ8MTXP02FHKEI.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgccccgtcacccttggacacgcccggcctccatctcctgcaggtcaagtcagacgtccctcgttacaacgataagtagggaacaccttacttgagtttggttacagcagaggccaggccaatcaccgaacggcgtaccttaatttagtaaggtttctagggcgggtactcgtggggtacccagaccagtactcgaggcggcgagggtcggggtcgacgggcgtacgtgtactttacactacgtagaaggtaaactcgaacggcggtagggggtggggaagggtacgttagggaaaaggtagttcggggtttacgggggttttaactttacggtaggtacgtaaggtgtaaccggtaaggggttacgtagggttggtaccgggtcccgtttcggtaccgtccggtacgtacgggtttaccggggacgggggtaacggggaacccggtaaaacgggggtggaaagtaaacggtaaccgaaaacgggtaccgtggggttaacgccggttacgaaacccg

SEQ ID NO: 312379 - DNA, 677 bp, Homo sapiens
  misc_feature: GZ8MTXP02G64AY.11.28.C06.1.454.CMB.2.raw
  modified_base (461)..(461): a, c, t, g, unknown or other
  misc_feature (461)..(461): n is a, c, g, or t
  modified_base (518)..(518): a, c, t, g, unknown or other
  misc_feature (518)..(518): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctcgcccgtcacccgttggacacggcccggcctccatcctcctgcaggtcaagtcagacgtccttcgttacacgtaataagtacggaacctaccttattggtagttggttcagctaaggacgcacggacctaatccgtaccgaaggcctaaccttaagtttaagttaacggtttcgtacgggcggtactcggtccggggtaccaagacccgagtacttcgaaggtcggtacgtagggtcggggtacagggtcctcgtaggttacttcaactgtagactaancgagaggtagggtggaagtcgtaaggaaagtggtttacggggttacggtttttaaancggtagtacgtacggtacgacggtaggtacggtggttcggtccgtaccgtcgcgttacgggacgtacgggtcggggaaacgggtaacggtacgggtaacgggttacgaaacgtaaacgtaaccggaaacggttacggtcggtacggaccttaacgaccg

SEQ ID NO: 312380 - DNA, 823 bp, Homo sapiens
  misc_feature: GZ8MTXP02GB2LH.11.28.C06.1.454.CMB.2.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagcgagagataccacgaccggtgctcgatttagagctcacgtattgggtttggggctgatcaggactcctcagttcaccttctcacaatgaggctccctgctcagctccgtggggctgctaatgctctgggtcccagtgtccaggtggggatgttgtgttgactcagtctccactcctccctcgcccgtcacccgttggacncgccggcctccatcctcctgcgaggtacaagtcagcnccttcgtacaacgtaataacgtcggaacctactacgttgtaggttggttacaggtcaaggacggaccgaacggtccaagtcctaccgaaggtccttaacctttaaaatttacgttaacgggtttccgtaggggccgggtaactcgggtacggggtaccaagtacccgagtacttcgacggccggtagacggggtggggtcacggggtcgtaccttaggtaacttttaccaaaccgtaagtaggaaactacgtaccggagggtacggtaagggggttcgggaaagggtcgttaaaaggggtaagtttaagggtttcgggggttttaccggggttttaaatttaaccgggagttacgtaggggttaaccggacgggttaaacggggttaacggtaggggttaccgggttccggttaccccgttacgggtaccggttaccggttacgggtttacccgggggtaacccgggggaaacggggtaaccgggggtaaaccggttaaaacgggggtacggaaaacggttaaaacccgtaaacggtaaaaccgggttacggtacggggttacggtacctaacggtaacccg

SEQ ID NO: 312381 - DNA, 690 bp, Homo sapiens
  misc_feature: GZ8MTXP02JT9BZ.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactcctccctgcccgtcacccttggacacgccgcctccatcctcctgcaggtcaagtcagacgtccttcgttacgaacgaataaagtacgggaaacctaccttacgttggtaggtttggttacagcgaggacggccgaggccaactccgtaccgaaggtccgtacctttaaagtttaagttaaacggtttcgtagggtaccggtacgttcggtccggggtacccaaggacctaagtcgttacgaggccggacgtagggtcgggggtcaggggtccgtagttcggtactttaccgaacgtacgtaggaaagtaactacggaggacggtagggggtgggaacggtcgttagggaaagtggtttacggggttaggggttttactacgtgtactaggtacgacggtagggtacgtggtcggtcggtccgttcgctcggtacgtgggtccgggaagggaccgggtaacgtaggggtaggaaactaacgtaacggaaaacgtcggtcggcggtactcgaaccg

SEQ ID NO: 312382 - DNA, 696 bp, Homo sapiens
  misc_feature: GZ8MTXP02F0P8F.11.28.C06.1.454.CMB.2.raw
  modified_base (546)..(546): a, c, t, g, unknown or other
  misc_feature (546)..(546): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacacgccgcctccatcctcctgcaggtacaagtcaagacgtcccttcgttcaacgtataagtacgggaactaccttacttgtagtttggttaccagcaggacgccgacggccaaatctacccgaaggccgtacttaagtttaacgttaaggtttcaggggcggtactcggtcggggtacccagtaccagtattccgaaggcgacgtagggttcggggaccacggggccgtacgttacggtaacttttccgaaacgttaccgtagaaaggtaacctaggaacggtagggtaaagggggtcggaaggtgtagggaaagtgtttacggggtttacgggggttttaataccgngtaccgtaggttacgaccggttaaggggtacctgggttcgtcggtcccgttcgcctcggaccggtagttccgggggaacggtacggggtaacgacgggtggaacgtaacgtaaaccggaaacgtaggttcggtacggcgttacgaacccg

SEQ ID NO: 312383 - DNA, 816 bp, Homo sapiens
  misc_feature: GZ8MTXP02ILMS4.11.28.C06.1.454.CMB.2.raw
  modified_base (189)..(189): a, c, t, g, unknown or other
  misc_feature (189)..(189): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgccccgtnacccgttggacagccgcctccatctcctgcaggtcaagtcagacgccttcgtacaacgattaaagtgggaacctacctaacttgagttggttcagcaaggacggccaggacccaaatcctaccgaaaggtccgtaccttaaaagtttttaacgtaacggtttttaccgaaagggggtcccggggtaaaccttcccgggttaccggggggttacccccaaaagggacccccgtaaaggtacgttttacccggaaacggggtcccggggtaccctaaaggggtttcggggggttacccaaacgggggtcccggtaccgttagggttacttttaccaacgtaaccgttagaaggtaaactccggaagccgggttaagggggtagggacggtaccgttaagggaaacggttaagttcggggttttaacccgggggtttttaaatacccggttcgggaactaagttggacccggtaaagggggtttaaccgtagggtttcggtccggttacccgttcggaccgttcggtacggttacgggttacgggggaccgggtaacgggaaccggtaaaggggtcggaaaacgtaacgtaaaccgaaacggtacggtcggtacggtactacggtaaccg

SEQ ID NO: 312384 - DNA, 731 bp, Homo sapiens
  misc_feature: GZ8MTXP02FVNTY.11.28.C06.1.454.CMB.2.raw
  modified_base (235)..(235): a, c, t, g, unknown or other
  misc_feature (235)..(235): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccaggtggggatgttgtgttgactcagtctccactctccctgcccgtcacccttggacagcccggcctccatctcctgcaggtcaagtcagacncctgtcacgataaatggaactacctacttgagtttgttcagcagacggccaggccaatctacgaaggcgtaccttaaatttagtaaggtttcgagggcgggtactcgtcggggtacccagacccagtattacgaggcggcgagggttggggacaggggcgtccgttagtacttttaccgaacgtacttaggaaagtaataccgaggacggaagggggttagggaggtacgtagggtaaaacggtgtttacgggggttttaccggggttttaaatttaccggaggtacctaaaggttccgggaacgtaacgggggttactaacggggtttgggtaccgggtacccgttttcgggacctttccgggaccgtttaaacgggtttcccgggggaaacggggtaacgggggaaaaccggtaaaacggggttgggaaaacggggtaactaaaacggttaaaaaccggaaccggtttgggtaacggcgtttacggaaaccccg

SEQ ID NO: 312385 - DNA, 586 bp, Homo sapiens
  misc_feature: GZ8MTXP02GFU29.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatcctcctgcaggtcaagtcagacgcctcgttcacgataagtgggaactactacttgagttggttcagcagacggccagccaatcacgaggctaccttaatttagtaaggtttcaggcgggtactcgtggggtcccagaccagtatcgagcggcgagggtcgggtcagggctctgtatttcaacacgtagaagtaaacgtcgaaggcgagggggtggaggtcgtaggaaagtgttaggggtttacgggtttaatacgtgactaggtgacggagggttacagggtgtcggtcctcgcgtcgtcgtagggttccgggagggtaacgggaaccgtagggtaggacgtaagtaacgaaacgtacgtcggtaggctagacc

SEQ ID NO: 312386 - DNA, 746 bp, Homo sapiens
  misc_feature: GZ8MTXP02FHQI7.11.28.C06.1.454.CMB.2.raw
  modified_base (469)..(469): a, c, t, g, unknown or other
  misc_feature (469)..(469): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgcccgcctccatcctcctgcaggtcaagtcaagacgtcctcgttcaacgaataagtcgggaactacctacttgagtttggttcagcagacggcaggccaatctaccgaaggctaccttaaagtttactaaggtttcgagggcgggtacttcggtacggggtccccaagacccgagtacttcgaggccggacgtaggggtcggggtacaggggtcgtcgttgtaactttccaacgtacgtgaaagaacgtacgagggacggttagggggngggtaacggcgttaagggaaagtaggtttgggtttacgggggttttaaattaccggtgtacgtaagttacggaccggtaaaggggttacgaacggggttggttaccgggtacccgtttccggtcccggttaccggtacggttacgggggtttacccggggggaaccggggtaaaccgggggtaaacccggttaaaagggggacgggtaaaacggtaacgttaaaacccggggaaaaacggttacgggttggttaccgggggacttaccggggaaccc

SEQ ID NO: 312387 - DNA, 522 bp, Homo sapiens
  misc_feature: GZ8MTXP02IK1MS.11.28.C06.1.454.CMB.2.raw
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (342)..(342): a, c, t, g, unknown or other
  misc_feature (342)..(342): n is a, c, g, or t
  modified_base (442)..(442): a, c, t, g, unknown or other
  misc_feature (442)..(442): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctcctgcaggtcaagtcagagcctcgttcacgataagtggaacncctactgagttgttcagcagngccagcaatcncaagcnctaatttntaagtttcaggcggatcgtgggtcccagaccagatcgagcgnagtgggtcaggcgctgacttcaacactagagaatcgaagtcgaggggtgaggtcagaagagttggttcgggtttaattactgctagtgacgagggtacgngtcgtacgtcctcgcgtcgcgtagtccggacggaacggacgtaggtgaagaacgtacgaaacgtacgtgtacggctacgc

SEQ ID NO: 312388 - DNA, 511 bp, Homo sapiens
  misc_feature: GZ8MTXP02IPPUW.11.28.C06.1.454.CMB.2.raw
  modified_base (268)..(268): a, c, t, g, unknown or other
  misc_feature (268)..(268): n is a, c, g, or t
  modified_base (330)..(330): a, c, t, g, unknown or other
  misc_feature (330)..(330): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (429)..(429): a, c, t, g, unknown or other
  misc_feature (429)..(429): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatctcctgcaggtcaagtcagagcctcgttcaacgataatggaacactactgagttgttnagcagagcagcaatcacagcactaattatagtttcaggcggatctggggccagaccagattnagcgcatgggtcaggcgctgatttcanactgagaatnagcaaggggtggagtcaggaagatcggtcggggttttaatacttgacattagcgacgggtanaggttgcggtccgtcgctcggcaagtttcggacggagggaccaagggtggaagaagtacgaaaacgactagtggcctagacc

SEQ ID NO: 312389 - DNA, 586 bp, Homo sapiens
  misc_feature: GZ8MTXP02GT43R.11.28.C06.1.454.CMB.2.raw
  modified_base (292)..(292): a, c, t, g, unknown or other
  misc_feature (292)..(292): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctcatcctctgcaggtcaagtcagagcctcgttcacgaataagtgggaaccacctattgagttggttcagcagagccaggccaatcncaaggccactaatttataaggtttctaggcggtactcgtggggtcccagacctagatcagcgcaggtgggacaggcgtctagtatttccgactacgtagaagtaataccgaggcgaagggggttgggaggtacgtaaggaaaggtagttagggttaccgggggttttaatttaacgtgtacgtagttagaccggtaagggttaacgaggtggtcggtccttcgacgttcgcgtaggttccgggacggaacggtacgaaggtgagaacgtacaaaaggactggtacgctagaccg

SEQ ID NO: 312390 - DNA, 550 bp, Homo sapiens
  misc_feature: GZ8MTXP02HSW69.11.28.C06.1.454.CMB.2.raw
  modified_base (399)..(399): a, c, t, g, unknown or other
  misc_feature (399)..(399): n is a, c, g, or t
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacacgccggcctccatcctcctgcaggtcaagtcagagcctgttcacgataatggaacacctactgagttggttcagcagaggccaggaccaatctccaaggcgaccttaaatttataaaggtttctaggcgggactcgtcggggtccagaccagattcagcgcgagtggggtcaggcgctgactttcacactgagatcgagngagggtgggagcgtagaagacgttgggttcgggtttattacgttgcagtgcgaggtacgtaggtgtcgtcgttcgctacgcgagttccgggagggtacggaccgaagggtcgggagtaacgtacaaaacggtactggtacggtctaggacc

SEQ ID NO: 312391 - DNA, 600 bp, Homo sapiens
  misc_feature: GZ8MTXP02GX6NZ.11.28.C06.1.454.CMB.2.raw
tcagcgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactcctccctgcccgtcacccttggacagccgcctccatctcctgcaggtcaagtcagagtccctcgttcacgataatgggaacacctattgagttggttcagcagaggccaggccaatctaccaaggctacctaaagtttataaggtttctagggcggactcgtggggtacccagaaccagtatcaggcggcaggtggggtcagggcgctgtatttccacgaactgaagaatcgagcgaggggtagggaggacgtgaaagtagttagggttcggggttttaattacggtgtacgtagtagacgtaggtaacgtaggtggttaggtccgttcgcgttcgacgtacggttccgggcgggaaacgggtaccgaaaggggtggaaagaacgttaaacgaaaacggtaacgtaggtacggacgtacgaaccc

SEQ ID NO: 312392 - DNA, 600 bp, Homo sapiens
  misc_feature: GZ8MTXP01EFX05.41.53.E09.1.454.CMB.2.raw
  modified_base (498)..(498): a, c, t, g, unknown or other
  misc_feature (498)..(498): n is a, c, g, or t
tcagtctatactatcacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggtaggtttggtaaagccgtggggacgtcccttagactctcctgtgcagcctctggacttcactttcagtaaccgcctggatcgaccgtgggtcccgccaggcctccggaggggaagggggctgggagtggggttggccgttaagtagaaccaagcgtaggacggtggacagcagactaacgctcgccaccggtagaaacggcagactcacatacacaagagatagtaattaacgaaaagtgtaacggtgtactcgtgggactagatacgaaccagcctaggaaaccnccggaagaccacgcggccttcttacttacgttgtcgtgggttattcggtttacaacggttcgggaaccgtagggtaccccgttgggttcccaaccggttccc

SEQ ID NO: 312393 - DNA, 580 bp, Homo sapiens
  misc_feature: GZ8MTXP02HBE7F.41.53.E09.1.454.CMB.2.raw
  modified_base (261)..(261): a, c, t, g, unknown or other
  misc_feature (261)..(261): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
tcagtctatactatcacgaccggtgctcgatttagagagagtgtgttgagctctgggagaggagccccagccttgggattcccaggtgttttcattcagtgatcaggactgaacacagaggactcaccatggagtttgggctgagctggattttcctgctgctattttaaaaggtgtccagtgtgaggtgcagttggtggagtcgtgggggaggtttggtaaagccgtggggagtcccttagactctcctgtgcagcctcnggattcactttcagtaacgcctggatcgaccgtgggtccgccgaggcctaccggaaggggaggggcgtgggaggtggggttcggaccgttagtacgaaaccaaagcgtaggacggtgggacagacagactacggctgccaccgtagaaagcagatcgaacntcanaagngatagacttanaaaacgntacggtntctatcganaganacgacacgcacgaacgacggagacacgacgtacgtacttagtacgtgtacgtaggtacttcggttacgaacggttaccggaccgtacggtacccgtcggtaccctaccgtcc

SEQ ID NO: 312394 - DNA, 631 bp, Homo sapiens
  misc_feature: GZ8MTXP02ID4TT.41.53.E09.1.454.CMB.2.raw
  modified_base (182)..(182): a, c, t, g, unknown or other
  misc_feature (182)..(182): n is a, c, g, or t
  modified_base (266)..(266): a, c, t, g, unknown or other
  misc_feature (266)..(266): n is a, c, g, or t
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
tcagtctatactatcacgaccggtgctcgatttagagagagtgtgttgagctctgggagaggagccccagccttgggattcccaggtgttttcattcagtgatcaggactgaacacagaggactcaccatggagtttgggctgagcgtggtagtttcctaggcctgacttaagtttaaaggngtccagtgtgaggtgcagttggtggagtcgtgggggaggtttggtaaagccgtggggatccttagctctctgtgcagctctgtntctactcacgtacgcgngagtcgcgtcggtccgcgcgcgcggaggaggngnggnggtggtgtcgtagtagaacgaacgacgtacggaggacggacgacgacgacgacgacgcgtcgaccgacgtacgaacgacgacgtactactactactactacgaagagtaatagtaataacgaaagtaacgtacgtcgtacgtcgtacgagagagtagacgacgacgtacgaacgacgacgacgacgacgtacgtacttacttacgtacgttacgttacggttacggtttacgttacggttaaccgggttaccggggtaacccgggtaacccgggttaacccggttacccggtacccggttacccgttcccg

SEQ ID NO: 312395 - DNA, 755 bp, Homo sapiens
  misc_feature: GZ8MTXP02JH9IU.41.53.E09.1.454.CMB.2.raw
tcagtctatactatcacgaccggtgctcgatttagagagagtgtgttgagctctgggagaggagccccagccttgggattcccaggtgttttcattcagtgatcaggactgaacacagaggactcaccatggagtttgggctgagctggattttcctgctgctattttaaaggtgtccagtgtgaggtgcagttggtggagtcgtgggggtagtttggaaagccgtggggactccctagactctcctgtgcagcctcgtggtacttctactttcagtaaccgctggatcgacccgtgggtcccgccgaggcctaccgggaaggggaacggggctaggggaggttggggtcggtacccgttaagttaacgaaacccgtaaagccgtagggacgggtcggggacaggaccaaggacctacggctcggacccgtaacccggtagggaaaacggcctaaggtacttccaaaccctagtaccctagaaaggtagacttaggtaaactttaacgaaaaaggtacgttaacgggttcgttaccgtacgttacgaccgttaaggaacgttaacggaaaccgtaccgtacccgttaacgggaaacccgtaaccgggaaacggaaccctaacgaccggtacccgttaacgttacgttaacgtcggttacggtaggggttaacgtttcgggtttacgaaccggtttacccggggaccggtaaaccgggggttaaccccttcggggtacccctaccggtttcccccg

SEQ ID NO: 312396 - DNA, 769 bp, Homo sapiens
  misc_feature: GZ8MTXP02HTIJW.41.53.E09.1.454.CMB.2.raw
tcagtctatactatcacgaccggtgctcgatttagagagagtgtgttgagctctgggagaggagccccagccttgggattcccaggtgttttcattcagtgatcaggactgaacacagaggactcaccatggagtttgggctgagctggattttcctgctgctattttaaaaggtgtccagtgtgaggtgcagttggtggagtcgtgggggagtttggtaaagcgtggggactcccttagactctcctgtgcacgcctcgtggtacttctactttcaagtaacgccgtggatcgaccgtcgggtcccgcgaggcctaccgggaaggggacggggcgtaggggtacggttggggttacggacccgtttaaagtaacgaaaccgaaagtcgtagggtacgggtacgggaccaaggcaacggtacgtaccggtcgtcggacccgaacccggtaaggaaaaccgggcaaacggtactttacccggaaacccttattaccccgtaaacgaaaaaggggttacttaaacgttaagtaaaaccgtttaaaacgaaaacggttacggttaccggttcttacgttacgagacgtaaagtacgtaacgaaaccgacgtaccgaacggaaaacccgacggaacgtaaccgaccgtaaccggttaccgttaactttaaacgttacgttacgggtacggttacgggttacgtttacgggtttacgaaccggttcccggggaaaccgtacccggggtacccgtacggtacccgttacccgtcc

SEQ ID NO: 312397 - DNA, 413 bp, Homo sapiens
  misc_feature: GZ8MTXP01EWOX3.19.60.F05.1.454.CMB.2.raw
  modified_base (402)..(402): a, c, t, g, unknown or other
  misc_feature (402)..(402): n is a, c, g, or t
  modified_base (408)..(413): a, c, t, g, unknown or other
  misc_feature (408)..(413): n is a, c, g, or t
tcagtactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggacctaagggaccaagggtggaaatcaaacgaactgtggcctgcacatctagtcttcatcttcccgcatctgacacgagagtactgagcgggctggcaagggcncatagnnnnnn

SEQ ID NO: 312398 - DNA, 411 bp, Homo sapiens
  misc_feature: GZ8MTXP01BBMI0.19.60.F05.1.454.CMB.2.raw
  modified_base (240)..(240): a, c, t, g, unknown or other
  misc_feature (240)..(240): n is a, c, g, or t
  modified_base (396)..(396): a, c, t, g, unknown or other
  misc_feature (396)..(396): n is a, c, g, or t
  modified_base (403)..(404): a, c, t, g, unknown or other
  misc_feature (403)..(404): n is a, c, g, or t
  modified_base (406)..(411): a, c, t, g, unknown or other
  misc_feature (406)..(411): n is a, c, g, or t
tcagtactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctcgacgttcggcaagggaccaaggtgaaatcaaacgactgtgcctgcacatctgtcttcatctcccgcatctgacacgagagtactgacgcgggactgggacaagggcncagtagnngnnnnnn

SEQ ID NO: 312399 - DNA, 409 bp, Homo sapiens
  misc_feature: GZ8MTXP01AM1BD.19.60.F05.1.454.CMB.2.raw
  modified_base (240)..(240): a, c, t, g, unknown or other
  misc_feature (240)..(240): n is a, c, g, or t
  modified_base (402)..(403): a, c, t, g, unknown or other
  misc_feature (402)..(403): n is a, c, g, or t
  modified_base (405)..(409): a, c, t, g, unknown or other
  misc_feature (405)..(409): n is a, c, g, or t
tcagtactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacgtagtcatctccgacgttcggccaagggaccaaggtggaaatcaaacgaactgtgcctgcaccatctgtcttcatccttcccgctatctgacacgagagtactgagcggctggcaaggcacatagnngnnnnn

SEQ ID NO: 312400 - DNA, 426 bp, Homo sapiens
  misc_feature: GZ8MTXP01BVKUF.19.60.F05.1.454.CMB.2.raw
  modified_base (240)..(240): a, c, t, g, unknown or other
  misc_feature (240)..(240): n is a, c, g, or t
  modified_base (329)..(329): a, c, t, g, unknown or other
  misc_feature (329)..(329): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (407)..(408): a, c, t, g, unknown or other
  misc_feature (407)..(408): n is a, c, g, or t
  modified_base (410)..(426): a, c, t, g, unknown or other
  misc_feature (410)..(426): n is a, c, g, or t
tcagtactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgctagtgtattactgtcagcagtacgtagttcatctcgacgttcggcaagggaccaagggtgaaatcaaacgactgnggctgcacatctgtcttcatccttcccgctatcngacacgagactacgngacggcggtcgtggacgacggcacagagnngnnnnnnnnnnnnnnnnn

SEQ ID NO: 312401 - DNA, 424 bp, Homo sapiens
  misc_feature: GZ8MTXP01B2GGM.19.60.F05.1.454.CMB.2.raw
  modified_base (410)..(410): a, c, t, g, unknown or other
  misc_feature (410)..(410): n is a, c, g, or t
  modified_base (416)..(417): a, c, t, g, unknown or other
  misc_feature (416)..(417): n is a, c, g, or t
  modified_base (419)..(424): a, c, t, g, unknown or other
  misc_feature (419)..(424): n is a, c, g, or t
tcagtactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtgcagtgggtctgggacagacttcattctcaccatcagcagactggagcctgaagattttgcagtgtattactgtcagcagtacggtagttcatctccgacgttcggccaaggggaccaaggtaggaaatcaaacgactgtggcctgcacatctgtcttcatccttcccgcctactctgactacgagagtaacgtggacggcggggctgggcaagggcncatagnngnnnnnn

SEQ ID NO: 312402 - DNA, 408 bp, Homo sapiens
  misc_feature: GZ8MTXP02JPGAX.19.60.F05.1.454.CMB.2.raw
  modified_base (404)..(408): a, c, t, g, unknown or other
  misc_feature (404)..(408): n is a, c, g, or t
tcagtactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcgccaagggaccaaggtggaaatcaaacgaactgtggcctgcaccatctgtcttcatcttcccgccatctgacacgagagtactgagcgggctggcaaggcgcatagnnnnn

SEQ ID NO: 312403 - DNA, 405 bp, Homo sapiens
  misc_feature: GZ8MTXP02ISLWW.19.60.F05.1.454.CMB.2.raw
  modified_base (240)..(240): a, c, t, g, unknown or other
  misc_feature (240)..(240): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (401)..(405): a, c, t, g, unknown or other
  misc_feature (401)..(405): n is a, c, g, or t
tcagtactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtggaaatcaaacgactgtgctgcacatctgtcttcatctccgccatctnacacgagagtactgacgngggactggcaaggcgcatagnnnnn

SEQ ID NO: 312404 - DNA, 408 bp, Homo sapiens
  misc_feature: GZ8MTXP02JVDJQ.19.60.F05.1.454.CMB.2.raw
  modified_base (404)..(408): a, c, t, g, unknown or other
  misc_feature (404)..(408): n is a, c, g, or t
tcagtactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgactagtgcctgcaccatctgtcttcatcttcccgcatctgacacgagagtactgagcgggactgggcaaggcgcatagnnnnn

SEQ ID NO: 312405 - DNA, 436 bp, Homo sapiens
  misc_feature: GZ8MTXP02IKCA0.19.60.F05.1.454.CMB.2.raw
  modified_base (387)..(387): a, c, t, g, unknown or other
  misc_feature (387)..(387): n is a, c, g, or t
  modified_base (404)..(404): a, c, t, g, unknown or other
  misc_feature (404)..(404): n is a, c, g, or t
  modified_base (418)..(418): a, c, t, g, unknown or other
  misc_feature (418)..(418): n is a, c, g, or t
  modified_base (424)..(436): a, c, t, g, unknown or other
  misc_feature (424)..(436): n is a, c, g, or t
tcagtactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagatttgcagtgtatactgtcagcagtacggtagttcatctccgacgttcggaccaaagggaccaaaggtaggaaaatacgaaaaacgaactagtggacctgaccaccattctagtctcattcttcccgcatctgacacganagtactgacggcggtgnggacgaaagggccnaagagnnnnnnnnnnnnn

SEQ ID NO: 312406 - DNA, 429 bp, Homo sapiens
  misc_feature: GZ8MTXP02H1P2F.19.60.F05.1.454.CMB.2.raw
  modified_base (240)..(240): a, c, t, g, unknown or other
  misc_feature (240)..(240): n is a, c, g, or t
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
  modified_base (406)..(429): a, c, t, g, unknown or other
  misc_feature (406)..(429): n is a, c, g, or t
tcagtactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctcgacgttcggccaagggccaagggtggaaatcaaacgactgtggcctgcaccatctgtctcatcttcccgccatctgacacgngagtactgagcgggntgggcaaggcgcatagcgannnnnnnnnnnnnnnnnnnnnnnn

SEQ ID NO: 312407 - DNA, 421 bp, Homo sapiens
  misc_feature: GZ8MTXP02IPE7J.19.60.F05.1.454.CMB.2.raw
  modified_base (240)..(240): a, c, t, g, unknown or other
  misc_feature (240)..(240): n is a, c, g, or t
  modified_base (413)..(421): a, c, t, g, unknown or other
  misc_feature (413)..(421): n is a, c, g, or t
tcagtactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggaccaagggaccaagggtgaaatccaaacgaactgtgcctgcacatctgtcttcatccttcccgcatctgacacgagtagtactggacgcgggactggacaagggcgacataggnnnnnnnnn

SEQ ID NO: 312408 - DNA, 540 bp, Homo sapiens
  misc_feature: GZ8MTXP01EAB6H.52.54.E10.1.454.CMB.2.raw
  modified_base (239)..(239): a, c, t, g, unknown or other
  misc_feature (239)..(239): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
  modified_base (447)..(447): a, c, t, g, unknown or other
  misc_feature (447)..(447): n is a, c, g, or t
tcagcgcagtacgacacgaccggtgctcgatttagatcgtagcagaacacacaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagagccggcaggcccctgtgtggtgatgtataaagacactgagagccctcagggactccctgacgcgattctctggctcccaggtcgagggacaaacgggtcacattggccatcagtggagtccgaggacagaggacgaggactggaacttattagttgtnaatcaanagacaccattgtacttatcgtnttcggaacttggacgttaccgaagggtccaaccggttcccttaggggtccaacggaaccccgaacgggccccaaacccctcttccgttaaccc

SEQ ID NO: 312409 - DNA, 607 bp, Homo sapiens
  misc_feature: GZ8MTXP01CYPQG.52.54.E10.1.454.CMB.2.raw
  modified_base (240)..(240): a, c, t, g, unknown or other
  misc_feature (240)..(240): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtacagcagaagccggccaggcccctgtgttggtgatgtaataaagacactgagaggccctcgagggatccccgtgacgtcccgtattctcgttcgggccttacccgaagggttcgaagggggtaaaccaaaccggggttccaacgtaagttcgggaccctattccgaggttgggagtcccaagggacagggaggacggaggctaggaacttattattggtacaaatacaaacagaacacctaagttggtaaccttagtgttcttcgggaaacttcggacgaccgtaaacgggttccaacccggttcttacggggtcaacggccccaaagggcccaaacccccgtaattcgtaaccc

SEQ ID NO: 312410 - DNA, 543 bp, Homo sapiens
  misc_feature: GZ8MTXP01ES6GA.52.54.E10.1.454.CMB.2.raw
  modified_base (286)..(286): a, c, t, g, unknown or other
  misc_feature (286)..(286): n is a, c, g, or t
tcagcgcagtacgacacgaccggtgctcgatttagatcgtagcagacacacaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggngatgtataaagacactgagacggccctcgagggactccccgtgagccgatttctctggcctccagggtcagggacaacgggtcacattggccatcagtggagtccaggcagaggacgaggctgacttattagttgtacaatcaaacagacacctaagttgtaacttatcgtcttaacggaacttgaccgaccgaaaggtccaccgttccgttaggggtcacgccccgaacgggccccaaccctaacgttcgtaaccc

SEQ ID NO: 312411 - DNA, 538 bp, Homo sapiens
  misc_feature: GZ8MTXP01A24NG.52.54.E10.1.454.CMB.2.raw
  modified_base (200)..(200): a, c, t, g, unknown or other
  misc_feature (200)..(200): n is a, c, g, or t
  modified_base (242)..(242): a, c, t, g, unknown or other
  misc_feature (242)..(242): n is a, c, g, or t
  modified_base (399)..(399): a, c, t, g, unknown or other
  misc_feature (399)..(399): n is a, c, g, or t
  modified_base (462)..(462): a, c, t, g, unknown or other
  misc_feature (462)..(462): n is a, c, g, or t
tcagcgcagtacgacacgaccggtgctcgatttagatcgtagcagaacacacaaaggggggggagcctagctgtgctgtgggtccaggaggcagaactctgggtgtctcaccatggcctggatccctctacttctccccctcctcactctctgcacaggctctgaggcctcctatgagctgacacagcccaccctcggtntcagtgtccccaggacagacgccaggatcacctgctctgganatgcattgaccaaaccgatatgcttatggtaccagcagaacgccgggcacggcccctgtgttggtgatgtaataaagacaagtggagaccggccctcgaggggactcccgtagacgcgtattctcgtcggctccgagggtcgagggacaacggtcangttggccatcgagtggagtccaggcaggggaggcgagctagactattattgtactaatcaacngaacacgttattacggttattaacgtgttacgttcggactgacgaaccgtacggtcgaccgtcgttgggtaacccg

SEQ ID NO: 312412 - DNA, 511 bp, Homo sapiens
  misc_feature: GZ8MTXP01CIK4K.52.54.E10.1.454.CMB.2.raw
  modified_base (241)..(241): a, c, t, g, unknown or other
  misc_feature (241)..(241): n is a, c, g, or t
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (481)..(481): a, c, t, g, unknown or other
  misc_feature (481)..(481): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgttggtgatgtataaagacactgagaggccctgagggactcccgtgacgccgatttcgtctcggctaccgagggtcgaggggaacaacgggtcacagttgcatcagtggagtccaggcaggaggacgagggctagactattatgtacaatcaangacactatgtactntcgtntaacggattgacacgaaggtcaccgttcngggtcacgccacggccaaccctgttcgtcc

SEQ ID NO: 312413 - DNA, 576 bp, Homo sapiens
  misc_feature: GZ8MTXP01CXB3E.52.54.E10.1.454.CMB.2.raw
  modified_base (245)..(245): a, c, t, g, unknown or other
  misc_feature (245)..(245): n is a, c, g, or t
tcagcgcagtacgacacgaccggtgctcgatttagatcgtagcagaacacacaaaggggggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccagggacagacggccaggatcacctgctctgganatgcattgaccaaaccgatatgtcttattggtaccagcagaacgccggcacggcccctgtgtggtgatagtaataaagacatgacgacggtccctacgagggactcccgtagacgcgtacttctcgtcgcctacgaggtcgagggacaacggtcacgtagttcggactagtcgaggtggacgtccgaggcgaggggacggacggaggcgtagaactagtttattcgtactaaagtaccaaacgaagaactaccttagtttacgttactttaatcgttacgttcggacgttggaccgaaccgtacggtccaccggttccgttcggtaacccg

SEQ ID NO: 312414 - DNA, 675 bp, Homo sapiens
  misc_feature: GZ8MTXP01AR5F3.52.54.E10.1.454.CMB.2.raw
  modified_base (180)..(180): a, c, t, g, unknown or other
  misc_feature (180)..(180): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctggtntcagtcgtccccaggacagacggccaggatcacctgctcgtggagatgctattcgacccaaaccgatatgtcctttagttcggtaaccagcgaaggaacggcccgggaccacggtcccctggttcggttggtgagtgtaaataaacgacacgtaggagacggtccctagacggggtactcccgtaggacgtcccggttattcgtacgtcggaccttaacccggacgggtaacgaacggggtaacctaaaccgggtaccacgttaacgttcgggaccctagtccggaaggttcgggacgtccgagggacgaacggacgggacggaggtctacggtaacttaggtttaacttcggttaaccaaattaccgaaaactacgtaacctaccgttaagtttacggtacctttagtcgttcgttaacgtacttcggaccacgtagtccacggttcttcgggccaccgaaccgaacggaccccaccgtaacgttccggtaacc

SEQ ID NO: 312415 - DNA, 546 bp, Homo sapiens
  misc_feature: GZ8MTXP01AH19D.52.54.E10.1.454.CMB.2.raw
  modified_base (240)..(240): a, c, t, g, unknown or other
  misc_feature (240)..(240): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgttggtgatgtataaagacactgagaggccctcgagggatcccgtgagccgattctcgtggctaccgagggtcagggaccaacgggtcacagttggcccatcaggtggagtccaggcaggaggcgaggctgactagttattgtcaatcaacagacacctattcggtacttatgttcttcggaacttggaccgaccgtaaagggtccaacccggttcgttcggggtccacggccccgaaacgggccccaaaccccgtcttcgtaacccc

SEQ ID NO: 312416 - DNA, 614 bp, Homo sapiens
  misc_feature: GZ8MTXP01A717A.52.54.E10.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (286)..(286): a, c, t, g, unknown or other
  misc_feature (286)..(286): n is a, c, g, or t
  modified_base (448)..(448): a, c, t, g, unknown or other
  misc_feature (448)..(448): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctgganatgcattcgaccaaacgntatgcttatggtaccagcagagccggcacggcccctgtgttggngatgtaataaacgcacgtgagacgcctgagggactcccgtagacgccgtattcgtcgtcggccttacccgagggtcaacggggtaccaacgggttcaactagttcggacctatcgagtggacgtccgaggacaggagacgagctagacttagttagtcgtanaactacgaaacacgacctacctagtttacggttacttagttcgttaccggttaacggaaacttcggaaccgttaaccgtaaacggtcccgttaccccggttcggttacgggggtccaaccgggtcccgaaaaccgggccccaaaaccccgtcttcggttaaccccg

SEQ ID NO: 312417 - DNA, 631 bp, Homo sapiens
  misc_feature: GZ8MTXP01EBXXJ.52.54.E10.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (283)..(283): a, c, t, g, unknown or other
  misc_feature (283)..(283): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacacgccaccctggtgtcagtcgtccccaggacagacgccaggatcacctgctctgganatgcattcgaccaaacgntatgcttatggtacagcagagccggcaggcccctgtgttgngatgtaataagacactgagacgccctagagggactcccgtgacgtccgtattctcgtcggcctaccgaggtcgagggtacacgggtcacgtagttcggaccctatcgtaggtggacgtacgaggacgaggacggacgaggactagtaacttagttacgttagtactaaactacaaacgagaacctaccgtaacgtttggtaaccttaagttcgttaccgttaacggtaaaccgttgaaccgttaaaccgtaaacgggttcccttaccgggttcccggtttcgggtaacccgaacccgtaaccccgaaaccgggtaccccaaaaccccggtcgtttaaccgtaaccccg

SEQ ID NO: 312418 - DNA, 503 bp, Homo sapiens
  misc_feature: GZ8MTXP01B070D.52.54.E10.1.454.CMB.2.raw
  modified_base (424)..(424): a, c, t, g, unknown or other
  misc_feature (424)..(424): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
tcagcgcagtacgacacgaccggtgctcgatttagatcgtagcagaacacacaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggcaggcccctgtgtgtgatgtataaagacactgagaggccctgagggatcccgtgacgccgattctctggctccaggtcgagggacaacgggtcacattggccatcagtggagtccaggaccaggagacgaggctggactattagttgtcaatcaacngacaccattggtacttatgtctcggattgcgacgaaggtcaccgttcnggtcncgccgagcccaccctaacgttcgtcc

SEQ ID NO: 312419 - DNA, 575 bp, Homo sapiens
  misc_feature: GZ8MTXP01D3E5K.52.54.E10.1.454.CMB.2.raw
  modified_base (242)..(242): a, c, t, g, unknown or other
  misc_feature (242)..(242): n is a, c, g, or t
  modified_base (418)..(418): a, c, t, g, unknown or other
  misc_feature (418)..(418): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgccaggatcacctgctctggagatgcattgaccaaacgntatgcttatggtaccagcagaacgccggcacggcccctgtgtggtgatgtaataaagacacgtgagacgggccctagagggactcccgtagacgccgtacttctcgtggcctccgaggtcgaagggacaacgggtcactagtcgccatcagtgatccgaggacaggagacgaggcngatattatgtacaaatcaaacagaactacctagtttaggtacctttaagtcgttcttaacgggaacttggaacccgaacgtaaggggttccaacccgttcggttcggttcgaaccgtaaccccgaacgggacccttaaaccccctcgttccgtaacg

SEQ ID NO: 312420 - DNA, 611 bp, Homo sapiens
  misc_feature: GZ8MTXP01DN9XS.52.54.E10.1.454.CMB.2.raw
  modified_base (242)..(242): a, c, t, g, unknown or other
  misc_feature (242)..(242): n is a, c, g, or t
  modified_base (281)..(281): a, c, t, g, unknown or other
  misc_feature (281)..(281): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgcattcgaccaaacgntatgcttatggtacagcagagccggcagccctgtgtggngatgtaataaagacacgtgagacgcctgaggactcccgtgacgccgattctcgtggcctaccgaggtcgagggacaaacgggtcacgtagttcggacctagtcgaggtggacgtccgagggaccgaagggagggaccgagggactaggaactttagtttagttgtacaaattacaaacgacgtaccaaccgtaagtttcggttaacttagtcgttacgttaacgaacttggaccgttaaaccgtaacgggtccaacccggttccggttacgggtccaaccgggaaccccgaaacgggaccccttaaaccccggtaacttcggttaacccc

SEQ ID NO: 312421 - DNA, 581 bp, Homo sapiens
  misc_feature: GZ8MTXP01B70UR.52.54.E10.1.454.CMB.2.raw
  modified_base (283)..(283): a, c, t, g, unknown or other
  misc_feature (283)..(283): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgtcttatggtaccagcagagccggcaggccctgtgtggngatgtaataaagacactgagacggccctgagggtactcccgtgagccgtattctcgtggctaccgaggtcgagggacaacggtcacagtcgccatcgagtggagtccgaggcaggaggacgagctagaacttattagttcgtacaaatacaaacagaaccaacctaagtttacggtaactttagtcgttccgtttaacgggaaacttggacccgttaaccgtaacggttcccacccggttccgttaggggtaaccacggaaccccgaacgggaccccaaccccgtaacttcgtaaccc

SEQ ID NO: 312422 - DNA, 558 bp, Homo sapiens
  misc_feature: GZ8MTXP01ADDDG.52.54.E10.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcactgctcgtgganatgctattcgaccaaacgntatgtcttatggtaccagcagacgccggcacggccctgtgttggngatntaagtaaagacactggagacggccctacgagggactccgtgacgccgtattctcgtcggctaaccgaggtcgagggaacgtacgggtcacgtacgttcggaccagtcgaggtgggacgtaccgaggacgaggacggacggagcgtagacttattagttagtacaatacaacacgaacactagttacgtattatcgtctaagacttcgacacgtaacgtcaccgttcgttcggtcacgcccgaacgccttaccctcgttcgtaaccc

SEQ ID NO: 312423 - DNA, 526 bp, Homo sapiens
  misc_feature: GZ8MTXP01BVUW7.52.54.E10.1.454.CMB.2.raw
  modified_base (242)..(242): a, c, t, g, unknown or other
  misc_feature (242)..(242): n is a, c, g, or t
tcagcgcagtacgacacgaccggtgctcgatttagatcgtagcagaacacacaaagggggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgccaggatcacctgctctgganatgcattgaccaaacgatatgtcttatggtaccagcagaagccggccacggcccctgtagttggtgatagtataaagacactgagacggcctgaggatccctgagcgattctctgctcgaggtccagggacaacgagtcaacgtattcggaccatacgagtggagtccgaggcgaggacggacgagggctggacttaatttagttgtactaatacaaacaagacttacctattggttattaacttgttcttaggaactgcgacaggttctaaccgttcgtcggg

SEQ ID NO: 312424 - DNA, 603 bp, Homo sapiens
  misc_feature: GZ8MTXP01EHIXD.52.54.E10.1.454.CMB.2.raw
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgatatgcttatgtaccagcagaacgccggccacggcccctgtggttggtgatgtaataaagacacgtagagacggccctacgaggactcccgtgacgccgtatctcgtggcctaccgagtcgagggacacggcactagtggacctagtcagtggagtccgaggacaggaggacgaggctagtacttatttagtgtactaaactacaaacgacgaacctactagtttaggtacttattcgttcgttaacgtaaacgttggtaacccgttaaccgaacgggtaccttacccggttcccgttacggggttaaccacccggaaccccgaaaccggaccccgaaacccctccgttaacggtaacccc

SEQ ID NO: 312425 - DNA, 637 bp, Homo sapiens
  misc_feature: GZ8MTXP01C7U13.52.54.E10.1.454.CMB.2.raw
  modified_base (252)..(252): a, c, t, g, unknown or other
  misc_feature (252)..(252): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccacccctcggtgtcagtcgtcccccaggacaggacggccaggatccacctgctctggagatgcattgaccaaacgatatgtnttatgtacagcagaacgccggccaggcccctgtgttggtagatgtaagtaaagacactgagacggcccgtcgagggtactcccgtagacgtacccgtacttctcgtcggtcctaaccgaggtccggaaggaccaacgggtcacagttcgcatcgaggtcggagtccgaggacgaggaggacgaggtcagtaacttatttagttagtactaaactacaaacgacgaaacctacgttaaagttacgttaacgtttaacgtcgtttacggtttaacgggaaccttacgggaaccgttaacccgtaaacggtccgttaaccccggttccgttacgggtaacccgaacgcccccgaaacggacccccaacccctaacgttccgttaaccc

SEQ ID NO: 312426 - DNA, 593 bp, Homo sapiens
  misc_feature: GZ8MTXP01BJKO5.52.54.E10.1.454.CMB.2.raw
  modified_base (243)..(243): a, c, t, g, unknown or other
  misc_feature (243)..(243): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtcgtcccaggacagacggccaggatcacctgctctggagatgctatcgaccaaacgntatgtcttagtgtacagcagacgccggcacggcctgtgtgtgatgtataaagacacgtagagacggcctcgaggtactccgtgacgccgtacttcgtcgtcgtccgtaccgacgggttttcgaacgggtaacgaaaccggtcgacgtacgttcgggacctagtcgaaggtcggtacgtaccggacggacgaggagggacgaaggcgtagattattagttgtactaactacaaacagacctactacgttagtacttagttcgttacgttaacgtaacgttcgaccgacgtaacgtccgttaccgttccgttcggtcacgaacccgaccggacccacccctaacgttcgtcc

SEQ ID NO: 312427 - DNA, 589 bp, Homo sapiens
  misc_feature: GZ8MTXP01AEJ9E.52.54.E10.1.454.CMB.2.raw
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (293)..(293): a, c, t, g, unknown or other
  misc_feature (293)..(293): n is a, c, g, or t
  modified_base (457)..(457): a, c, t, g, unknown or other
  misc_feature (457)..(457): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacgccaggatcacctgctctgganatgcattgaccaaacgntatgtcttagttggaccagcaagaacggccgggccacggcccctgtggttggngatgtaagtaaagcactggagacggccctacgagggactcccgtggacgcccgtattctcgtcggcctaccgagggtcgaagggaacctaacgggtcacgtagttcggccattcgaggtgacgccgaggcagggagggacgaggataggtaacttattagggtntacaactacaaacgcgaactacctagtttacgtacttagtcgtttcctaacggacttcgaccgttaccgtaacggtcccacggttcgcgggtaaccacggaaccacggaccccaaccgtaacttcgtaaccc

SEQ ID NO: 312428 - DNA, 677 bp, Homo sapiens
  misc_feature: GZ8MTXP01BAXTR.52.54.E10.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
tcagcgcagtacgacacgaccggtgctcgatttagatcgtagcagacacacaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctcgtgganatgctatcgaccaaacgntatgtcttagtggtacagacaggaacgccggcacggtccccgtggtcgttgtagagtagtaataaagactagtggacgcggccctacggaggtctaccgtggacgtccgtattcgtcgtacggtcctaccggagggtccggaacgggtaaacgtaccgggactacgtacgttacgggcctacgtacgtacgggttacggtacggccgaacgggacgaaacggggtacgggtaacgggacgggtacgttaccggtaaacgttaacgtttaggtttaacgtacgtaaactaaccgaaacaccggaacctacgttaacgttagttaccttagttcgttcgtaacgtacgttacgaccgttaacgtacggtcccgttacccggttcgttacgggccaccgtcccgaacccggtaccccaacctcccgttcgttaacccc

SEQ ID NO: 312429 - DNA, 560 bp, Homo sapiens
  misc_feature: GZ8MTXP01EXDNL.52.54.E10.1.454.CMB.2.raw
  modified_base (341)..(341): a, c, t, g, unknown or other
  misc_feature (341)..(341): n is a, c, g, or t
  modified_base (412)..(412): a, c, t, g, unknown or other
  misc_feature (412)..(412): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtacagcagaagccgggccagacccctgtgttggtgatgtataaagacactgagaggccctcgagggatccccgtgagccgagttctcngggctccaggtccgaggggacaacgggtcacagttggcccatcgagtggatccgaggcgagaggacgagcngtacgtattacgttgttacgaatacaaacgacacaccgtacttggttacttaagttgtcgttaacgttacgttacgcgaccgtaaacggtccgaccgttccgttcggtcgcggaacccctacgggaccaccccgtaacccttgtcccc

SEQ ID NO: 312430 - DNA, 628 bp, Homo sapiens
  misc_feature: GZ8MTXP01A6TI2.52.54.E10.1.454.CMB.2.raw
  modified_base (245)..(245): a, c, t, g, unknown or other
  misc_feature (245)..(245): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctcgtggagatgctattcgaccaaacgntatgtcttatgtacagcagaacgccggcaggtcccctgtgtggtgatgtaataagacatgagacgccctagaggtactcctggacgtccgtattctgtcggctaccgaggtcgagggacacggtcaacgtgttcggacctagtccgtaggtacgggacgtacccggagggaccgaagggacgggacggacggtctagtaacttatttaggtacgtactaaagtaccaaacgtaacgtaacctaacgttaagtttacggttaaaccttgtacgtttaccgtaacggtaacgttcgtaacccgttaaccgtaaggtacccgttaccgttccgttcggggaacctacggaaccccaacggaccccaacccgtcgttcgttaacccc

SEQ ID NO: 312431 - DNA, 614 bp, Homo sapiens
  misc_feature: GZ8MTXP01AW3WT.52.54.E10.1.454.CMB.2.raw
  modified_base (182)..(182): a, c, t, g, unknown or other
  misc_feature (182)..(182): n is a, c, g, or t
  modified_base (249)..(249): a, c, t, g, unknown or other
  misc_feature (249)..(249): n is a, c, g, or t
  modified_base (287)..(287): a, c, t, g, unknown or other
  misc_feature (287)..(287): n is a, c, g, or t
  modified_base (331)..(331): a, c, t, g, unknown or other
  misc_feature (331)..(331): n is a, c, g, or t
tcagcgcagtacgacacgaccggtgctcgatttagatcgtagcagaacacacaaagggggtgggtccaggaggcagaactctgggtgtctcaccatggcctggatccctctacttcctccccctcctcactctctgcacaggctctgaggcctcctatgagctgacacagccaccctcggtntcagtcgtccccaggacagacggccaggatccacctgctcgtggagatgctattcgaccaaaccgtntatgcttatggacagcagacgcggcacgccctgtgtgngatagtaataagacactggagacggccctcggaggtactcccgngacgccgtattctcgtcgcctacgagggtccgagggaccgacggtcactagtcgacctagtcgaggtggtacgcccgagggaccgagggaacgggacggacgggtacgtacggtaaactttagttaacgggttaggtaacctaaacttaccaaacgtaacgtaacccaacttacgttaggttaaccttagtcgttcttaacggaacgttcggaaccgttaccgtaacggtcacccggttcgcgggtccaccgaacccgacggaccccaaccctcgccgtaacc

SEQ ID NO: 312432 - DNA, 636 bp, Homo sapiens
  misc_feature: GZ8MTXP01CYBNJ.52.54.E10.1.454.CMB.2.raw
  modified_base (287)..(287): a, c, t, g, unknown or other
  misc_feature (287)..(287): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttatggtaccagcagaagccggcacggccctgtgtggtnatagtataagacacgtgagacggccctacgagggactccgtagacgcgtacttctcgtggtcctaccgagggtcgaagggaccaaacgggtcacgtagttcgggaccctatacgaggtcgggacgtcccgaagggacaagggaacgggaacggtagggcttagtaacgttatttaacggttggtaactaacttacgaaacgaacgacctaactagtttgtaactttaagtcgttacgttcgggaaacttcggtaaccgaacgtaaacgggtccttaacccggttccgttacgggtccaacgggtaaccccaaaccgggaccccttaaaccccgtcgttccgttaacccg

SEQ ID NO: 312433 - DNA, 689 bp, Homo sapiens
  misc_feature: GZ8MTXP01CU7D7.52.54.E10.1.454.CMB.2.raw
  modified_base (250)..(250): a, c, t, g, unknown or other
  misc_feature (250)..(250): n is a, c, g, or t
  modified_base (295)..(295): a, c, t, g, unknown or other
  misc_feature (295)..(295): n is a, c, g, or t
tcagcgcagtacgacacgaccggtgctcgatttagatcgtagcagaacacacaaagggggtgggtccaggaggcagaactctgggtgtctcaccatggcctggatccctctacttcctccccctcctcactctctgcacaggctctgaggcctcctatgagctgacacacgccacccgtggtgtcagtcgtccccaggacacggacggccaggatccacctgctcgtggagatgctatcgaccaaacgtntatgtcttatggtaccagcaagacgccggcacggccctgtgtggngatagtaataaacgacacgtgagacgcccgtcgagggtactcccgtagacgtcccgtattctcgtcggctaccgaggtccggaagggacctaaacgggtccactaggttcgacccagttacgaggttaggacgtaccgaagggacgagggaacggacggacgggtccttaaggtaacctttaagtttacggtttacggtaactaaacttacgaaacgtaacgaaacctaccggtttaaatttacggttaacgtttaacgttcggttaccgttaaccgggtaacttccgggaaccgttaaccggttaaacgggttcccttaacccgggttccggtttcgggaacccgaccggaacccctaaacgggacccccttaacccgtcgttaacgtaaccc

SEQ ID NO: 312434 - DNA, 731 bp, Homo sapiens
  misc_feature: GZ8MTXP01AWTDS.52.54.E10.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (328)..(328): a, c, t, g, unknown or other
  misc_feature (328)..(328): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctctgganatgctattgaccaaacgntatgcttatgtaccagcagagccggcacggcccctggtgtggtgatagtaataaagacagtgagacgccctagacggtactcccgngacgtccgtatttcgtcgtacggccttacccggaggtccgaacggggaaaccgtaaaccgggttccaacgtacgttacgggaccctagtccgtagggttacgggacgtacccgaggggaccgaagggaacgggaacggacggtccgtacggtaaacttttaaggtttaactttggtaaacgtaaacgttacccgtaaaacctaacggaaaccccttaacccgttaaagttttacgggttaaacctttaggttaccggtttacggttaaccggggtaaacttacgggacccgttaaaccggtaaaacgggttcccgaacccggttccgttacggggttaacccgacccggtaacccccggtaaaccggaccccgaaaacccccttcggttaacgttaacccccg

SEQ ID NO: 312435 - DNA, 681 bp, Homo sapiens
  misc_feature: GZ8MTXP01B2YI4.52.54.E10.1.454.CMB.2.raw
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (285)..(285): a, c, t, g, unknown or other
  misc_feature (285)..(285): n is a, c, g, or t
tcagcgcagtacgacacgaccggtgctcgatttagatcgtagcagacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcatgaccaaacgntatgcttatggtaccagcagaacgccggcacggcccctgtgtggnatgtataagacagtgaggcgcctagacggctccgtgacgtccgtacttctcgtcgcctaaccggaggtcggagggtaacccgtacgggtcaacgtaggttccggactagttcgaggtacggacgtccgaaggaacgaagggacgggacggacggtacgtacgtaaccgtttaaagtttacggttacggtaactaaacgttaaccgaaacgaaccggtaacctaaccgtttaaggtttacggttaacctttagttcgttaccggttaaccggtaacttacggtaaccgttaacggtaaaccggttccgaacccggttccggttaccgggggttaacaccccggtaacccggtaaaccccgggaccccttaaccccggttaaccttccggttaacccc

SEQ ID NO: 312436 - DNA, 583 bp, Homo sapiens
  misc_feature: GZ8MTXP01A86VW.52.54.E10.1.454.CMB.2.raw
  modified_base (225)..(225): a, c, t, g, unknown or other
  misc_feature (225)..(225): n is a, c, g, or t
  modified_base (243)..(243): a, c, t, g, unknown or other
  misc_feature (243)..(243): n is a, c, g, or t
  modified_base (407)..(407): a, c, t, g, unknown or other
  misc_feature (407)..(407): n is a, c, g, or t
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
tcagcgcagtacgacacgaccggtgctcgatttagatcgtagcagacacacaaagggggtgggtccaggaggcagaactctgggtgtctcaccatggcctggatccctctacttctccccctcctcactctctgcacaggctctgaggcctcctatgagctgacacacgccaccctggtgtcagtcgtccccaggacagacggccaggatcacctgctcgtgganatgcattcgaccaaacgntatgtcttagttggtaccagcgaagaacggccgggccacggtccccgtgttggttggtagtatagtaataaagacatgagacggcctgaggctccgagcgcctattcgacgtcgctaaccgaggtcgacggtaacgacggtcacgtagttcggctagtgtaggnggacgtccgaggcgaagggacggacggaggtctagtaacttagtttaggtntaacgaactacaanacgactactagttggttaactagttcgtacgttaaccgaattcggacacggtaacgccttaccgttcgttacgggcacgaacccggagtaccccaaccctgttccgtaacc

SEQ ID NO: 312437 - DNA, 676 bp, Homo sapiens
  misc_feature: GZ8MTXP01BAOOG.52.54.E10.1.454.CMB.2.raw
tcagcgcagtacgacacgaccggtgctcgatttagatcgtagcagacacacaaagggggtgggtccaggaggcagaactctgggtgtctcaccatggcctggatccctctacttctccccctcctcactctctgcacaggctctgaggcctcctatgagctgacacacgccaccctggtgtcagtcgtccccaggacagacggccaggatcacctgctcgtggagatgctattcgaccaaacgatatgtcttagtggtaccagcagaacgccgggaccacggcccctggtgttggtagatagtaagtaaagacagtggacgcggccctagagggtactcccgtagacgtccgtactttcgtcgtacggccctaaccggagggtcgaaacggggtaacctaaacgggtccaacgtagttcggaaccctagttacgaggttcggacgtcccgaagggaccgaagggacggggaacgtacggactagtaacgtttaatttaggttacggtaaccaaacttaccgaaactaacggaacccttaacgttaacgtttagggtaacctttaagtcggttaccttaacgggtaacttcggaacgttaacccgtaggtacccttaccggttcgttcgggtaaccaccggtaacccgaaccgcccttaacccgtcgttaacgtccc

SEQ ID NO: 312438 - DNA, 641 bp, Homo sapiens
  misc_feature: GZ8MTXP01AKW1M.52.54.E10.1.454.CMB.2.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacaggacggccaggactcacctgctcgtgganatgctattcgaccaaacgntatgtcttatggaccagcagacgccggcaggccctgtgtggngatagtaanaagcacgtagagacggccctgacgggtactcccgtgacgtccgtattcgtcgtcggctacccgagggtcgagggaacacggtcacgtagtcgcatcgaggtggacgtccgaggacgaggacgggacggacggtaccgtaggtaacttagtttaagttacggtaactaactaccgaaacgacgtaacctaaccgttaagtttacggttaactttaacgttcggttccggttaacggaaacgttcggacccgttaacggtaaccgtaccgttacccggttccgttacgggtaacccaccggcccgaaacccgggaccccttaaaccccgtcgttccggttaacccc

SEQ ID NO: 312439 - DNA, 625 bp, Homo sapiens
  misc_feature: GZ8MTXP01DSKFY.52.54.E10.1.454.CMB.2.raw
  modified_base (223)..(223): a, c, t, g, unknown or other
  misc_feature (223)..(223): n is a, c, g, or t
  modified_base (246)..(246): a, c, t, g, unknown or other
  misc_feature (246)..(246): n is a, c, g, or t
  modified_base (330)..(330): a, c, t, g, unknown or other
  misc_feature (330)..(330): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacgccaggatcacctgctctgganatgcattcgaccaaaccgattangtcttatggtaccagcaagaacgccggcacggcccctgtgttggtgatgtaataaagacacgtgagacggccctgaggctccgngacgtcattctcgtgcctaaccgaggtcgaacgggacaacggtcacgacgttcggacctatcgaggtggacgtccgaaggccgaaggaggacggaggctaggtaacttaagttaagttcggtaactaaactacaaacgaacgaacaaccgtaagtttggtaaccttagttcgttacgttaacgggaacttacggaccgttaaccggtaaacggtccttaacccggttccgttacggggaacctaacccgaacccggaaacccggacccttaaccccggtaacttccggtaacccc

SEQ ID NO: 312440 - DNA, 743 bp, Homo sapiens
  misc_feature: GZ8MTXP01CEFJ9.52.54.E10.1.454.CMB.2.raw
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagtatgcattcgaccaaacgatatgtcttatggtaccagcagacgccggcacgccctgtgtgngatagtaanaagacagtgagacggccctagaggtactcccgtgacgtcccgtacttcgtcgtcggtcctaccgaagggtccggaacgggtaaacccgaaacggggttccaaacgttacggtttaccgggaccctaagttaccgagggttacgggtaacggtacccggaaggggacccgaaaggggaacgggaaccgggagggtacccgttaagggtaaacctttaagtttaactttaacgggttaaaccgtaaattaaccccgaaaagaccggaaaccttacccgttaaagttttacgggttaacccttttagtttcgttaccggtttaacgggtaaaccttcgggaccgttaacccgtaaacgggtttcccaaaccccgggtttcgttaccggggtaaccaacccgggcccctaaaacccgggccccttaaaccccgtccgttcggttaacccccg

SEQ ID NO: 312441 - DNA, 612 bp, Homo sapiens
  misc_feature: GZ8MTXP01B1DAD.52.54.E10.1.454.CMB.2.raw
  modified_base (249)..(249): a, c, t, g, unknown or other
  misc_feature (249)..(249): n is a, c, g, or t
  modified_base (499)..(499): a, c, t, g, unknown or other
  misc_feature (499)..(499): n is a, c, g, or t
  modified_base (539)..(539): a, c, t, g, unknown or other
  misc_feature (539)..(539): n is a, c, g, or t
  modified_base (558)..(558): a, c, t, g, unknown or other
  misc_feature (558)..(558): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacacgccaccctggtgtcagtcgtccccaggaccaggacggccaggactcacctgctcgtggagatgactattcgaccaaacgnttatggtccttagtacggtaccagcaagaacgccgggccacggtcccctggtgttggtgattagtaataagacacgtggacgacggtccctaggacggtactcccgtaggacgtcccgtattctcggtcggccttacccgagtcggaacgggtaccgtacgtcacgtagttcggacctagtcaggtcggacgtccgaggacgaggacgacggtggactaggtattacttagtacgtacaagtacaacganaaccgtattacgttagttcttagtcgttctaacggtaacnggtaaccacgtacggtccncgttcgttaccggcaccgtcccgaacggccccttaacccggtcttcggtaaccc

SEQ ID NO: 312442 - DNA, 600 bp, Homo sapiens
  misc_feature: GZ8MTXP01EJAMS.52.54.E10.1.454.CMB.2.raw
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcacggcccctgtgttggtgatgtaataaagacactgagacggccctgagggactcccgtgagccgtattcgtcgtggcctaccgaggtcgaggggacaaacgggtcaactagttcgggaccctatcgaggtgggacgtccgaggcaaggaggacggaggctagacttattagttcgtactaaatcaaactacgacctacaatttcggtaactttagtcgttcgttaacggtaaacttggaccgaaacgtaacgggtccttaacccggttcgttcggggttccaacggccccgaaacgggaccccaaaccccgtaacgttcggttaacccc

SEQ ID NO: 312443 - DNA, 618 bp, Homo sapiens
  misc_feature: GZ8MTXP01A66CV.52.54.E10.1.454.CMB.2.raw
  modified_base (243)..(243): a, c, t, g, unknown or other
  misc_feature (243)..(243): n is a, c, g, or t
  modified_base (285)..(285): a, c, t, g, unknown or other
  misc_feature (285)..(285): n is a, c, g, or t
tcagcgcagtacgacacgaccggtgctcgatttagatcgtagcagacacacaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggactcacctgctcgtggacatgctattcgaccaaacgntatgcttatggtacagcagagccggcaggccctgtgttggtnatagtataagacactgagacgccctagagggtactcccgtaggacgtaccgtacttcgtcgtcgggtccttacccgggaacgggtccggtaaacggggaaccgaaaccgggttacaacgtaacgtttcgggaccctagttccgaaggttcggtacgaccgaggaccgtaagggacggacggaggcgtacgtaattagttagtgtactaatcaaacgacacactattaggtacttaagtcgtcgttaacgaacgttcggacgttaccgaaaggtccaccgttcgttccgggaacaccggaacccacggacccttacccgtaacgttcgtaaccc

SEQ ID NO: 312444 - DNA, 678 bp, Homo sapiens
  misc_feature: GZ8MTXP01A8IFW.52.54.E10.1.454.CMB.2.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
tcagcgcagtacgacacgaccggtgctcgatttagatcgtagcagacacacaaagggggtgggtccaggaggcagaactctgggtgtctcaccatggcctggatccctctacttctccccctcctcactctctgcacaggctctgaggcctcctatgagctgacacacgccaccctggtgtcagtcgtcccaggacaggacgccaggatcactgcctgtgganatgctattcgaccaaacgnttatgtcttagtacggtacagcagacgccggcacggccctgtgtggngatagtaanaagcacgtgacgacgcctacgaggtactccgtgacgccttagtctacgtcggcctaccggagggtccgaacgggaacctaacgggtactacgtacggttacggacctagtacgtaaggtacgggtacgtacccggagaccggtaaggacggtacgaggctaggtacttaagtttgtacgtaataactacgaaacgtacggtaaccacgttaagtttcgttaaccgtttagtacgttaccggttaacggaaacgttccggtaaaccggaaaccgtaccgggttccttaacccgggttccgggttaccgggttaacccgaaacccgtaaccccggtaaaccccgggaccccttaccccgtaacgttaacccgtttaaccccg

SEQ ID NO: 312445 - DNA, 734 bp, Homo sapiens
  misc_feature: GZ8MTXP01A2Y37.52.54.E10.1.454.CMB.2.raw
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggactccacctgctcgtggagatgctattcgaccaaacgtatatgtcttagttcgacngcgagacgccggcacggcctgtgtgnatagtaanaacgnacgtgagcgcctggaggtctccgtgacgtcgtacttctcgnggtccctcgaagggtccgaagggaaccctaacgggtccacgtagtcggacctatcgaggtgggacgtccgaggacgaaggtacgggacgacgggtactacgtaacgttaatttaacggggtgtttaaccaaacgttaccaaaacggtaccgtaacctaaacccgttaagttttaaccggttaaaccgttttaacgttccgggtttaaccggttaaccccgggttaaacgttacccgggaaacccggttaaacccggtaaaacggggtttcccccgttaaaacccggggtttcccgggttaaaccgggttaaccccgggaaccgttaacccccgggaaacccgggaaacccccttaaacccccgtaaccggttaaccgtttcccccgg

SEQ ID NO: 312446 - DNA, 646 bp, Homo sapiens
  misc_feature: GZ8MTXP01BD34G.52.54.E10.1.454.CMB.2.raw
  modified_base (223)..(223): a, c, t, g, unknown or other
  misc_feature (223)..(223): n is a, c, g, or t
  modified_base (309)..(309): a, c, t, g, unknown or other
  misc_feature (309)..(309): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtcgtcccaggacagacgccaggatcactgctctgganatgctattcgaccaaaccgtatatgtcttagttggtaccagcgaagaacggccgggccacggtcccctggtgttggtgatagtaanaaacgacagtgagacgccctgaggtactcccgtagacgccgtattcgtacgtcggcctaccgaggtcgacgggaaccgtaacgggtcacgtacgtcgacctatcgaggttcggacgtaccgagggacgagggaacgggaacggacggtcgtaagtaacgtttatttaggttacggttaactaaacttacaaacgaacaaccgtaaccttaagtttacgttactttagttcgttcgttaacggaacgttaggacccgttaacgaacggttaccgttcccggttccgttcgggtaacaccgaacccgtaaccggccccaacccgtaacgttcgtaaccc

SEQ ID NO: 312447 - DNA, 626 bp, Homo sapiens
  misc_feature: GZ8MTXP01BFNZ0.52.54.E10.1.454.CMB.2.raw
  modified_base (232)..(232): a, c, t, g, unknown or other
  misc_feature (232)..(232): n is a, c, g, or t
tcagcgcagtacgacacgaccggtgctcgatttagatcgtagcagaacacacaaagggggtgggtccaggaggcagaactctgggtgtctcaccatggcctggatccctctacttcctccccctcctcactctctgcacaggctctgaggcctcctatgagctgacacacgcccacccgtcggtgtcagtcgtccccaggacaggacggccaggactcacctgctcgtgganatgactattcgaccaaacgtatatgtcttagtcggaccagcgagacggccggcacggccctggtgtgtgatagtaataaagcagtaggagaccggcctagagggtactccgtaggacgtccgtacttcgtacgtcgccgttaccgaggtcggacgggaactacggtcacgtagttcgacctatcgaggtacgagtccgagggacgagggacggacggagcgtagtaacttagttatacgtaactaataccctaaagacgaccttaacgtagtttaggtaacttagtcgtacgtaacggtaacgttaggtccgaaacgtacgtaccgccgttcgggttccgtaaccgacccgaaccggaacccgtaccccttaaacccgtggttaacctaacccg

SEQ ID NO: 312448 - DNA, 728 bp, Homo sapiens
  misc_feature: GZ8MTXP01A13RC.52.54.E10.1.454.CMB.2.raw
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
tcagcgcagtacgacacgaccggtgctcgatttagatcgtagcagacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgaccaaacgntatgcttatgaccngcagagccggcaggccctggtgtggngatagtataaagcagtggacgacggcccctagacgggtacctcccgtaggacgtcccgtacttcgtcgtcggcccttaccgacgggtcgaaacggggaactaacccgggtacaacgtacgtttcgggaccctagtacgacgggttaggtacggttacccgaaggggaccgaagggtacgggaaaccgggcgggtactacgggtaaaccttagtttacggggttacgtaacccttaaagtaacccaaaaccgcgtaaacccgaccgttaaacgtttcgggttaaacctttaaggttccgttaccggttaacccggtaaacgttaccgggaacgttaacccgtaaacgggttcccgaacccgggttccggttaccgggggtaacccaaacccgggtaacccgaaaccgggacccccttaaaaccccgtaagtttccggtaaccccg

SEQ ID NO: 312449 - DNA, 634 bp, Homo sapiens
  misc_feature: GZ8MTXP01ARQZ4.52.54.E10.1.454.CMB.2.raw
  modified_base (184)..(184): a, c, t, g, unknown or other
  misc_feature (184)..(184): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
  modified_base (602)..(602): a, c, t, g, unknown or other
  misc_feature (602)..(602): n is a, c, g, or t
tcagcgcagtacgacacgaccggtgctcgatttagatcgtagcagaacacacaaagggggtgggtccaggaggcagaactctgggtgtctcaccatggcctggatccctctacttcctccccctcctcactctctgcacaggctctgaggcctcctatgagctgacacagcccacccgtcggtntcagtcgtccccaggacaggaccgccaggactccacctgctcgtggagatgctatcgaaccaaacgtntatgtcttagtcgacngcagacgccggcacggtccctgtgtgntatagtaataacganacgtgacggacgccctagaggtactccgtagacgtcgtacttcgtcgtcggtcctaaccggagggtccgaaggggaaccctaaacgggtcaacgttagtacggtaccagttacgaacggttcgggaacgtaccggaagggacgaacgggtacgggaccgtagggtactaggtaactttaattagggttcgtaaacaactaaccaaacgtacgactaccgttagtttaggtactttaggtctacgttaacgaacgttcgaccgttaccgacggtcccacgttcgttcggaacnccgaaccgacgaccccaccgtcttccgtaacc

SEQ ID NO: 312450 - DNA, 721 bp, Homo sapiens
  misc_feature: GZ8MTXP01DFLK5.52.54.E10.1.454.CMB.2.raw
  modified_base (241)..(241): a, c, t, g, unknown or other
  misc_feature (241)..(241): n is a, c, g, or t
tcagcgcagtacgacacgaccggtgctcgatttagatcgtagcagacacacaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaaccgntatgtcttattggtacagcagaagccgggaccacggcccctggtgttggtgatgtaataaagacagtgagacggccctcgagggactcccgtgacgtccgtattctcgtcggcctacccgaaggtccgagggtaacccgtaaacgggtcctaacgtacgtttcgggaccctagtaccgaggttacgggacgtacccgagggacgaacgggacgggaacggacgggtacgtacggtaaccgttaagtttaaggtttacggtaacctaaacgttaccaaaaccgtaacggtaaaccctacccgttaaagttttacgggttaacccttttaaggttcgttaccggtttaacggtaaaccgttcgggtaaccgttaaaccccgtaaacgggttcccgttaaacccggtttcccggttacggggttaaccaaacccggccccgaaaccgggacccccttaaaccccggtcttccggttaaccccg

SEQ ID NO: 312451 - DNA, 496 bp, Homo sapiens
  misc_feature: GZ8MTXP02HPKYB.52.54.E10.1.454.CMB.2.raw
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
tcagcgcagtacgacacgaccggtgctcgatttagatcgtagcagaacacacaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggccaggcccctgtgttggtgatgtataaagacactgagaggccctnagggatccctgacgccgattctctggctccgagtcgagggacaacggtcacagtgccatcagtgagtccaggcagaggacgaggctgactattattcgtanatcaananacactattgtattagtgtcgttacgactgacgacgacgtcaccgtcgcggtcacgaccacgacccacctctcgtc

SEQ ID NO: 312452 - DNA, 497 bp, Homo sapiens
  misc_feature: GZ8MTXP02HZRPJ.52.54.E10.1.454.CMB.2.raw
  modified_base (437)..(437): a, c, t, g, unknown or other
  misc_feature (437)..(437): n is a, c, g, or t
tcagcgcagtacgacacgaccggtgctcgatttagatcgtagcagaacacacaaaggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgctattggtaccagcagaagccgggccaggcccctgtgttggtgatgtataaagacactgagacggccctcgagggactccctgagcgtattctctggctccaggtcagggacaacggtcacattcgcatcagtgagtccaggcagaggacgaggctgactatattgtcaatcaaanagacacattcggtacttatgtacttcggaacttgcgacaacggtcaccgtctagggtacc

SEQ ID NO: 312453 - DNA, 547 bp, Homo sapiens
  misc_feature: GZ8MTXP02F9JAZ.52.54.E10.1.454.CMB.2.raw
  modified_base (368)..(368): a, c, t, g, unknown or other
  misc_feature (368)..(368): n is a, c, g, or t
  modified_base (426)..(426): a, c, t, g, unknown or other
  misc_feature (426)..(426): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtaataaagacactgagacggccctgagggactcccgtgagccgattctctcggctccgaggtcagggacaacggtcanattggccatcagtgagtccaggcagaggacgaggctgactagttatgtacaatcaaanagacactattaggtacttagtcgtacttacggaacttggacgtaaccaaagggtccaacccggtccgttaggggtccaacgaccccgaaacgggacccccaaaaccccgtactcgtaaccc

SEQ ID NO: 312454 - DNA, 752 bp, Homo sapiens
  misc_feature: GZ8MTXP02IVDMM.52.54.E10.1.454.CMB.2.raw
  modified_base (241)..(241): a, c, t, g, unknown or other
  misc_feature (241)..(241): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgcattgaccaaacgntatgcttattggaccagcagaacgccggccacggcccctgtgttggtgattgtataaagacactgagacggccctcgagggactcccgtgacgtccgtacttcgtcgtcgggtccttaccgacgggttcgaacggggtaacaaacccggggttcaaccgtaagtttcggggaccctaaagttcgaggttacgggacggttacccgaagggaccgtaaggggaacgggaacggaacggggtaccttagggtaaaacctttaacggttttaaatttacggttaaacctaaaacgttaccgaaaaccaaacggaaacccgttaaacccttaaggttttaacgggttaaccttttaaagtcgtttacccgtttaccggggaaaacttcggaccgtaaaaccgtaaacgggtttcccgaaacccggtttccggtacgggggttaacccaacccgggtaacccccgtaaaaccgggtaccccccgaaaaacccccgttcgttacccgtttaaccccg

SEQ ID NO: 312455 - DNA, 500 bp, Homo sapiens
  misc_feature: GZ8MTXP02I5R3N.52.54.E10.1.454.CMB.2.raw
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
tcagcgcagtacgacacgaccggtgctcgatttagatcgtagcagacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgntatgcttattggtaccagcagaagccggccaggcccctgtgttggtgatgtataaagacactgagaggccctcagggatccctgagccgattctctggctccaggtcagggacaacggtcacattggccatcagtggagtccaggcaggaggacgaggctgactattattgtnaatcaanagacaccattggtacttatgtcttcggaactgcgaccgagtcaccgtcctggtcgacgcccacggaccacccactcgtacc

SEQ ID NO: 312456 - DNA, 566 bp, Homo sapiens
  misc_feature: GZ8MTXP02IL0ZC.52.54.E10.1.454.CMB.2.raw
  modified_base (225)..(225): a, c, t, g, unknown or other
  misc_feature (225)..(225): n is a, c, g, or t
  modified_base (243)..(243): a, c, t, g, unknown or other
  misc_feature (243)..(243): n is a, c, g, or t
  modified_base (442)..(442): a, c, t, g, unknown or other
  misc_feature (442)..(442): n is a, c, g, or t
tcagcgcagtacgacacgaccggtgctcgatttagatcgtagcagaacacacaaagggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctgganatgcattgaccaaaccgntatgcttattggacagcagaagccggccacggccccctgtgttggtgatggtaataaaggaccactggagacggccctacgagggactcccgtggagcccgtattcctcgtggcctccgagggtccgaagggtacaacggtcacgattcggccatcgagtgagtccgaggcaggaggacggagcgtgacttattagttntacaatacaacagtacacctattggtacttatgttacttcggaacttgaccgaaccgtaacggtcctaaccgttcgtcgggtaaccacggaccccgaacggacccaaccccctactacgtaccc

SEQ ID NO: 312457 - DNA, 529 bp, Homo sapiens
  misc_feature: GZ8MTXP02I7CMA.52.54.E10.1.454.CMB.2.raw
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
  modified_base (335)..(335): a, c, t, g, unknown or other
  misc_feature (335)..(335): n is a, c, g, or t
  modified_base (392)..(392): a, c, t, g, unknown or other
  misc_feature (392)..(392): n is a, c, g, or t
tcagcgcagtacgacacgaccggtgctcgatttagatcgtagcagaacacacaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgganatgcattgccaaacgntatgcttatggtaccagcagaagccgggccaggcccctgtgttggtgatgtataaagacactgagaggccctnagggactcccgtgacgccgattcnctggctccgaggtccagggacaacggtcacagtgcatcagtgatccagcagagacgngctagactagttatgtacaatcaacagacaccattaggtacttatgtacttacggaacttagcgaaacctaaacggtcctaaaccgttcgttacggggcaacgacccgaaaacggcccaaaaccccacttcggaacc

SEQ ID NO: 312458 - DNA, 545 bp, Homo sapiens
  misc_feature: GZ8MTXP02HFACD.52.54.E10.1.454.CMB.2.raw
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
tcagcgcagtacgacacgaccggtgctcgatttagatcgtagcagaacacacaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaaccgatatgcttattggtaccagcagaagccggccaggcccctgtcgttggtgatgtataaagacactgagaggccctgagggatccctgagccgattcctctggctccgaggtcgagggacaacgggtcacattggccatcagtgagtccagcagaggacgagcngactattatgtacatcaaanagacacattaggtacttagtgtcttacggaacttggaccgtaacgaacggtcctaacccggtccgtacgggtaaccgacggaccccgaaacggacccccaaacccctacgtacggtaacccc

SEQ ID NO: 312459 - DNA, 593 bp, Homo sapiens
  misc_feature: GZ8MTXP02HXQB8.52.54.E10.1.454.CMB.2.raw
  modified_base (241)..(241): a, c, t, g, unknown or other
  misc_feature (241)..(241): n is a, c, g, or t
  modified_base (328)..(328): a, c, t, g, unknown or other
  misc_feature (328)..(328): n is a, c, g, or t
tcagcgcagtacgacacgaccggtgctcgatttagatcgtagcagaacacacaaagggggtgggtccaggaggcagaactctgggtgtctcaccatggcctggatccctctacttcctccccctcctcactctctgcacaggctctgaggcctcctatgagctgacacagccaccctggtgtcagtgtccccaggacagacggccaggatcacctgctctggagatgcattgccaaaccgntatgcttattggtaccagcagaacgccggccacggcccctgtgttggtgatggtaataaagacactgagacggcctgaggactcccngacgccgtattcctcgtggtctccgaggtcgagggacaacgggtcagtagttgaccagtcaggtggacgtaccgagcgaggaggacgaggcgtgaacttattaattgtataatcaaaccagaaccaactagtttacggtaactttaagtcgttactttacgggaaacttggaccgaaaccgtaaacggtccaacccgggttccgtacgggtaaccgacggaccccgtaaaaccggccctaaaacccccgtcgttaccggtacccg

SEQ ID NO: 312460 - DNA, 563 bp, Homo sapiens
  misc_feature: GZ8MTXP02IOVVT.52.54.E10.1.454.CMB.2.raw
  modified_base (240)..(240): a, c, t, g, unknown or other
  misc_feature (240)..(240): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
  modified_base (483)..(483): a, c, t, g, unknown or other
  misc_feature (483)..(483): n is a, c, g, or t
  modified_base (554)..(554): a, c, t, g, unknown or other
  misc_feature (554)..(554): n is a, c, g, or t
tcagcgcagtacgacacgaccggtgctcgatttagatcgtagcagaacacacaaagggggggagcctagctgtgctgtgggtccaggaggcagaactctgggtgtctcaccatggcctggatccctctacttctcccctcctcactctctgcacaggctctgaggcctcctatgagctgacacagcccaccctggtgtcagtgtccccaggacagacggccaggatcacctgctctgganatgcattgaccaaaccgatatgcttattggtaccagcagaagccgggccaggcccctgtgttggtgatgtataaagacactgagacggcccctgagggactccccgtagacgcgtattccgtcgtcgccttcgaagggttcgaacggggacaaaccgggttcaacgtaattgggacctagtccaggttgacgtccgaagggcaaggaggaccgaggctagacttattagttntacaatanaanacaacacctaattcggtaaccttagtcgtacgtttacgaaacttgacgtaaccgagttccgaaccgttcgngggtaaccc

SEQ ID NO: 312461 - DNA, 544 bp, Homo sapiens
  misc_feature: GZ8MTXP02HY2EY.52.54.E10.1.454.CMB.2.raw
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
tcagcgcagtacgacacgaccggtgctcgatttagatcgtagcagaacacacaaagggggggagcctagctgtgctgtgggtccaggaggcagaactctgggtgtctcaccatggcctggatccctctacttctccccctctcactctctgcacaggctctgaggcctcctatgagctgacacagcccaccctcggtgtcagtcgtccccaggacagacgccaggatcacctgctctgganatgcattgccaaaccgntatgcttattggtaccagcagaagccgggcaggcccctgtgttggtgatgtataaagacactgagacggccctcgagggactcccgtgacgcgtattctctcgggctccgaggtcgagggacaaacggtcacgattggaccattcagtggagtccagggcaggaggacgaggtctagatattaagttgtacaatacaacagacactattcggtacttaatcgttacttaccggaaacttggaccgtaaccgaaacggtcctaaccggttccgttacggggtacccg

SEQ ID NO: 312462 - DNA, 689 bp, Homo sapiens
  misc_feature: GZ8MTXP02IJUXX.52.54.E10.1.454.CMB.2.raw
  modified_base (223)..(223): a, c, t, g, unknown or other
  misc_feature (223)..(223): n is a, c, g, or t
  modified_base (298)..(298): a, c, t, g, unknown or other
  misc_feature (298)..(298): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctggtgtcagtcgtcccaggacagacggccaggatcacctgctctgganatgcattcgaccaaaccgatatgtcttagttcggtaccagacaggaacgccggccacggcccctgtggttggtanatagtataaacgactactagagacggccctagagggtactcccgtaggacgccgtattccgtcgtacggcctaccgacggtcgacgggaacctaaccggtacacgtagttcggaccatcgagtggacgtccgaggacgacggagggacgacggacgtacgtaaagtttacgtttaaagtttacggtaccaaaacgttaccggaaaaccctaacggtaaaccctaaccggttaagtttttaaccgggttaactttaacgttcggtttaccgtttaacgggtacgttaaccggacgtaaaaccgtaaacgggttccctaaacccggttccgttacgggggtaaccacccggaacccgaaccggacccccaaccccgttaccgtacgtaacccg

SEQ ID NO: 312463 - DNA, 561 bp, Homo sapiens
  misc_feature: GZ8MTXP02FTRIB.52.54.E10.1.454.CMB.2.raw
  modified_base (244)..(244): a, c, t, g, unknown or other
  misc_feature (244)..(244): n is a, c, g, or t
  modified_base (353)..(353): a, c, t, g, unknown or other
  misc_feature (353)..(353): n is a, c, g, or t
tcagcgcagtacgacacgaccggtgctcgatttagatcgtagcagaacacacaaagggggggagcctagctgtgctgtgggtccaggaggcagaactctgggtgtctcaccatggcctggatccctctacttctccccctcctcactctctgcacaggctctgaggcctcctatgagctgacacagcccaccctcggtgtccagtcgtccccaggacagacggccaggatcacctgctctgganatgctattgacccaaaccgatatgcttattggtaccagcagaacgccgggccaggcccctgtgttggtgatgtaataaagcactgagaccggccctgagggactcccgngagcgtattctcgtggcctcgaggtcgaacggggacaaacggtcactagttcgaccatcgaggtgacgtccgaaggcaaggacggacgaggtactggaacttagttagttagtacaaactacaacgtaacgaacacctagtttacggtacttagtcgttactacggaaagtcgaccgaacgtaacggtccgaccgtccgtcggtaccg

SEQ ID NO: 312464 - DNA, 506 bp, Homo sapiens
  misc_feature: GZ8MTXP02FP4MN.52.54.E10.1.454.CMB.2.raw
  modified_base (243)..(243): a, c, t, g, unknown or other
  misc_feature (243)..(243): n is a, c, g, or t
  modified_base (407)..(407): a, c, t, g, unknown or other
  misc_feature (407)..(407): n is a, c, g, or t
  modified_base (446)..(446): a, c, t, g, unknown or other
  misc_feature (446)..(446): n is a, c, g, or t
  modified_base (499)..(499): a, c, t, g, unknown or other
  misc_feature (499)..(499): n is a, c, g, or t
tcagcgcagtacgacacgaccggtgctcgatttagatcgtagcagaacacacaaagggggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtgtccccaggacagaccggccaggatcacctgctctgganatgcattgccaaaccgatatgcttattggtaccagcagaagccgggccaggcccctgtcgttggtgatgtataaagacactgagacggccctcgagggactcccgtagagcgacttctctgggctcgagggtcaggggacaacggtcacattgccatcagtgancagcagaggacgtaggctagactattatgtacaatcaanagacacattcggtacttatgtacttacggaatgcgaaccgagtccaccgtccngggtacc

SEQ ID NO: 312465 - DNA, 530 bp, Homo sapiens
  misc_feature: GZ8MTXP02F5BCV.52.54.E10.1.454.CMB.2.raw
  modified_base (312)..(312): a, c, t, g, unknown or other
  misc_feature (312)..(312): n is a, c, g, or t
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
tcagcgcagtacgacacgaccggtgctcgatttagatcgtagcagacacacaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggccccctgtgtggtgatgtataaagacactgagaggccctnagggatccctgagccgattctctggctccaggtcagggacaacggtcacattggccagtcagtggagtccaggcagaggacgnggctgactattatgtnaatgaaacanacactagttagtacttagtgttcgttacggactggaccgaacgtaacgtccgaccgtccgtagggtaaccacggacccgaaccggaccccaaaccccgtacgtcgtacc

SEQ ID NO: 312466 - DNA, 559 bp, Homo sapiens
  misc_feature: GZ8MTXP02GQJQL.52.54.E10.1.454.CMB.2.raw
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttattgaccagcagaagccggcacggcccctgtgttggtgatgtaataaagacacgtgagacggccctgagggactcccgtgacgccgtattcctcgtcggcctccgaggtccgagggaacaacgggtcacgtagttcggacctagtcgaggtggacgtccgaggcaggaggacgaggctgacttagttattgtacaatcaaacagacactagttacgtacttagtcgttcgttacggaactggaccgtacgtaaacggtccaaccgtcgtacgggtcaacgacccgaacggaccccaaaccctcgtactaccc

SEQ ID NO: 312467 - DNA, 672 bp, Homo sapiens
  misc_feature: GZ8MTXP02GRO66.52.54.E10.1.454.CMB.2.raw
  modified_base (328)..(328): a, c, t, g, unknown or other
  misc_feature (328)..(328): n is a, c, g, or t
tcagcgcagtacgacacgaccggtgctcgatttagatcgtagcagacacacaaagggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcacggccccctgtgttggtgatgtaataaagacactgagaggccctgagggatcccgnggagccgtattcctactggctccgagggtccgaaggggacctaaccgggtacaccgtaagtttcgggacctaaagttccgaaggttcggggaacgttcccgaaggggaccgaagggaacgggacgggaagggcccgttaggaacctttaaagtttagttacggttaacaaagttaccaaaacgtaacgaacaaccctaagtttacggttaacctttaagttcgtttaccgttacggaaacctttggaccgaaacccgtaaaggttcccaacccggtttccgtacggggttccgtaacggaccccgaaaccgggaccccaaaccccctacgtaccggttaacccc

SEQ ID NO: 312468 - DNA, 603 bp, Homo sapiens
  misc_feature: GZ8MTXP02I755W.52.54.E10.1.454.CMB.2.raw
  modified_base (242)..(242): a, c, t, g, unknown or other
  misc_feature (242)..(242): n is a, c, g, or t
tcagcgcagtacgacacgaccggtgctcgatttagatcgtagcagaacacacaaagggggggagcctagctgtgctgtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctgganatgctattgacccaaaccgatatgtcttattcggtaccagcaagaacgccggggccacggcccctgtgtggtgatgtaataaagacacgtgagccggccctgacgggactcccgtaggacgcgtacttcgtcgtggcctcgaggtcgacgggacaaacggtcacgtagttcggacctatcgtaggtcggacgtccgaggcgaaggacgggacgaggtccgtagaacttagttagttacggtacaaagtacaaactaacgaacctacgtaagtttccggtaaatttacgttacgttacgttaccggaaacgttcggaccgtaaccgtaacggtcccgtaccggttccggtacgggtaacccg

SEQ ID NO: 312469 - DNA, 553 bp, Homo sapiens
  misc_feature: GZ8MTXP02GU3S3.52.54.E10.1.454.CMB.2.raw
  modified_base (241)..(241): a, c, t, g, unknown or other
  misc_feature (241)..(241): n is a, c, g, or t
  modified_base (430)..(430): a, c, t, g, unknown or other
  misc_feature (430)..(430): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgttggtgatgtataagacactgagaggccctgagggactcccgtgagccgtattctctggcctccgagtcgagggacaacggtcacattggcccatcaggtgagtccaggcaggaggacgaggcgtgaacttattagttgtacaatcaaanacgacacctattaggtactttagtgttacgtttacggacttggaccgtaccgaacgtccgaacccgttccgtaggggtaaccacggacccctaacgggacccctaaccccggtactcgtaccc

SEQ ID NO: 312470 - DNA, 648 bp, Homo sapiens
  misc_feature: GZ8MTXP02HMN2N.52.54.E10.1.454.CMB.2.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
tcagcgcagtacgacacgaccggtgctcgatttagatcgtagcagaacacacaaagggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctgganatgcattcgaccaaaccgntatgtcttatggtaccagcaagacgccggccacgaccccgtgtaggttggtgagttagtaataaaagactacgtaggaggacggtcccctagaacgggacttccccgtaggacgtccgtacttcgtcgtcggtcctacccgtaggtcggaaacgggtaacaaccggggtcaacgtagttcggccctaagtcgaaggtaggaacgcccgagggacagggaacggacggtaggacgtagtacgtttatttagttacgtataactacaaacaagacctaacgtaagttaccggttattaagttcggttaccgttaacggtacggtcaaccggtaaaccgtaacgtccgaacccgttcggtaccgggaacacggaccccgaacggaccccaacccctcgtactaccc

SEQ ID NO: 312471 - DNA, 555 bp, Homo sapiens
  misc_feature: GZ8MTXP02GL0FC.52.54.E10.1.454.CMB.2.raw
  modified_base (243)..(243): a, c, t, g, unknown or other
  misc_feature (243)..(243): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgntatgcttatggtaccagcagaagccggcacgccctgtgtgtgatgtaataaagacacgtgacgacggccctacgagggactcccgtagacgcccgtattcgtcgtggtctccgaggtccgagggaacctaacgggtcacgtagttcggaccctagtcgagtggagtccgaggcaggaggacgaggtctagaacttattagtgtacaatacaaacacgactactagtttacggtacttagtgtacttacgaacgtgacgaacaacggttccaccgtctcgggaacacgacccaacggcccaaccacgtctacc

SEQ ID NO: 312472 - DNA, 567 bp, Homo sapiens
  misc_feature: GZ8MTXP02IKD48.52.54.E10.1.454.CMB.2.raw
  modified_base (284)..(284): a, c, t, g, unknown or other
  misc_feature (284)..(284): n is a, c, g, or t
  modified_base (483)..(483): a, c, t, g, unknown or other
  misc_feature (483)..(483): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccagggaagacggccaggatcacctgctctggagatgctattcgaccaaacgatatgcttatggtacagcagagcggcacgccctgtgtggtnatgtaataagcactgagacggccctagagggactccgtagacgcgtactttcgtctggtcctcgaggtcacgggggacaacgggtcaccgtagttcggcctagtcgaggtcggagtccggaggacgaggacgggacggaggacctagactttaagtttagttgtactaatacaacaacgtaccaactagttgtaacttntcgtcttacggactgaccgtacaaacgtcctacgttactgggtaccaacgcccgaaacggccccaacccgtacgtcacctaccg

SEQ ID NO: 312473 - DNA, 580 bp, Homo sapiens
  misc_feature: GZ8MTXP02IMC56.52.54.E10.1.454.CMB.2.raw
tcagcgcagtacgacacgaccggtgctcgatttagatcgtagcagacacacaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacgccaggatcacctgctctggagatgcattgaccaaacgatatgcttattggaccagcagacgccggccaggcccctgtgtggtgatagtataaagcactgagacgccctgagggactcccgtggacgtccgtattcgtcgtcggcctccgaggtccgagggaaccaacggtcaactagtcggccagtccgaggtggagtccgagcgaggaggacgaggctagactatttagtagttacaaatacaaacgaacgacctaacctagttcggttaaccttagttacgtaccgtttacggaaacttcggaaccgaaccgtaaacgtccgacccgtcgttacggccgacgacccgaaacgcccccaacccgacttcgacccc

SEQ ID NO: 312474 - DNA, 521 bp, Homo sapiens
  misc_feature: GZ8MTXP02HPII9.52.54.E10.1.454.CMB.2.raw
  modified_base (223)..(223): a, c, t, g, unknown or other
  misc_feature (223)..(223): n is a, c, g, or t
  modified_base (459)..(459): a, c, t, g, unknown or other
  misc_feature (459)..(459): n is a, c, g, or t
  modified_base (492)..(492): a, c, t, g, unknown or other
  misc_feature (492)..(492): n is a, c, g, or t
  modified_base (520)..(520): a, c, t, g, unknown or other
  misc_feature (520)..(520): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctgganatgcattgaccaaaccgatatgcttattggaccagcagaagccggcaggcccctgtgttggtgatgtataaagacactgagaggccctgagggactcccgtgagccgtattctcgtggctccgaggtcgagggacaacggtcacagtcgcctatcaggtggagtccaggcaggacggacgagggctaggaactagtttatgtacaatacaaacagacactagttcggtaactagtntcgttacggaactgacacgaacgcaccgttcgnggtcacgacccacggcccaaaccgctcnc

SEQ ID NO: 312475 - DNA, 573 bp, Homo sapiens
  misc_feature: GZ8MTXP02IEN41.52.54.E10.1.454.CMB.2.raw
  modified_base (238)..(238): a, c, t, g, unknown or other
  misc_feature (238)..(238): n is a, c, g, or t
tcagcgcagtacgacacgaccggtgctcgatttagatcgtagcagaacacacaaagggggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgccaggatcactgctcgnggagatgcattgaccaaaccgatatgcttagttggtaccagcagaacggccgggccacggtcccctgtggttggtgatgtaataaacgacacgtgagacgcccctgacggactcctggacgcgtacttctcgtgtcctcgagtacgaggacacggtcactagttcgaccagtcgagtcggagtccgagccgaggaggacgagggctaggacttagttacgttcgtactaagtacgaaacgacaactacccttagttacggttaacttaagttcgttacgtttacggacgttcgacccgttaacgacggtaccgtacccgttcgtacgggtacccg

SEQ ID NO: 312476 - DNA, 540 bp, Homo sapiens
  misc_feature: GZ8MTXP02JR3FP.52.54.E10.1.454.CMB.2.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
tcagcgcagtacgacacgaccggtgctcgatttagatcgtagcagaacacacaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccggccaggcccctgtgttggtgatgtataaagacactgagacggccctnagggactccctgacgccgattctctggctccgaggtcagggtacaacggtcactattggccatcagttggagtccgaggcaggaggacgaggctgactattatgacaatcaaangacacctattacgtacttagtntcttacggaacttgaccgaaccaacgggtcaacccggttctacggggtaacacgaccccgaaacggccccaaacccgacctacggtacccc

SEQ ID NO: 312477 - DNA, 562 bp, Homo sapiens
  misc_feature: GZ8MTXP02JKGX8.52.54.E10.1.454.CMB.2.raw
  modified_base (241)..(241): a, c, t, g, unknown or other
  misc_feature (241)..(241): n is a, c, g, or t
tcagcgcagtacgacacgaccggtgctcgatttagatcgtagcagacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagagccggcaggcccctgtgttggtgatgtaataaagacacgtgagacggtccctgacgggtactcccgtggacgccgtattcgtcgtggcctccgaggtcgaggggacaaacgggtcacgtagttcggaccatcgaagtggacgtccgaggcaggaggacgaggctgtactattagtcgtacaatacaaacacgacaacctagttaggtaacttagtcgtcgttacggatcggacgtaacgaacggtcctaaccgtcgtacggaacgacgacccgaacggccccaacccgtactcgtaccc

SEQ ID NO: 312478 - DNA, 568 bp, Homo sapiens
  misc_feature: GZ8MTXP02GYSBF.52.54.E10.1.454.CMB.2.raw
  modified_base (240)..(240): a, c, t, g, unknown or other
  misc_feature (240)..(240): n is a, c, g, or t
  modified_base (367)..(367): a, c, t, g, unknown or other
  misc_feature (367)..(367): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
tcagcgcagtacgacacgaccggtgctcgatttagatcgtagcagaacacacaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggcaggcccctgtgttggtgatgtataaagacactgagacggccctagagggtactcccgtgagccgattctctggctccgaggtcagggacaacggtcacnttggccatcgagtgagtccaggcaggagacgagcngactattatgtanaatcaanagacactagttagtacttagtcgtacttcggaaacttcgacgtaacccgtaaacggttcccgtaacccggttccgtacgggggttaaccaacccggtacccccgaaaacgggacccccaaaaccccccgtacttccggttaacccc

SEQ ID NO: 312479 - DNA, 577 bp, Homo sapiens
  misc_feature: GZ8MTXP02F6H3J.52.54.E10.1.454.CMB.2.raw
  modified_base (459)..(459): a, c, t, g, unknown or other
  misc_feature (459)..(459): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgtcttattggtaccagcagaacggccgggccacggcccctgtgttggtgatgtaataaagacactggagacggccctgagggactcccgtgacgccgtattctcgtggcctccgaggtcgaacgggactaacggtcactagttcggcctagtcgaggtggacgtccgaggacgaggaggacgaggctagacttattagttgtacaatacaanacgacactagttacggtacttagtcgttacttacggaactgaccgaaccgtaacggtcctacccgtccgtagggtaaccaacggacccgaacggaccccaaacccgtcgtcgtaaccc

SEQ ID NO: 312480 - DNA, 665 bp, Homo sapiens
  misc_feature: GZ8MTXP02GLSUV.52.54.E10.1.454.CMB.2.raw
  modified_base (241)..(241): a, c, t, g, unknown or other
  misc_feature (241)..(241): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggccaggcccctgtgttggtgatgtaataaagacactgagaggcccctgagggactccccgtaggacgtcccggtattcgtacgtcgggccttacccgaggggttccgaaagggggacctaaaccggggttcaaccgtaagtttcggggaccctaagttcgaaggttgggaacgttacccgaaggggccaagggacgggaacggaagggctacggtaacttagtttattggttacaaacttacaaaacgacgaaccacctagtttacggtaacctttagtcgttaccgtttacggaaacgtttgacccggtaaaccgtaacggtccaacccggttccgtcgggggtaaccaaccggaccccgaaaacgggcccccaaaacccccgtacttacggtaccc

SEQ ID NO: 312481 - DNA, 562 bp, Homo sapiens
  misc_feature: GZ8MTXP02GXOVK.52.54.E10.1.454.CMB.2.raw
  modified_base (311)..(311): a, c, t, g, unknown or other
  misc_feature (311)..(311): n is a, c, g, or t
  modified_base (418)..(418): a, c, t, g, unknown or other
  misc_feature (418)..(418): n is a, c, g, or t
tcagcgcagtacgacacgaccggtgctcgatttagatcgtagcagacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtataaagcactgagaggccctnagggatccctgagccgatctctggctccaggtcagggacacggtcacattggccatcagtggagtccaggcagaggacgaggctgacttattattgtacaatcaaanagacaccatttacggtacttaagtgtctttacgggaaacttggacgtaaacccgtaaagggtccaacccggttccgttacgggggtaacctaaccggacccccgtaaaacggggcccccaaaacccccgacgttcggtaacccc

SEQ ID NO: 312482 - DNA, 709 bp, Homo sapiens
  misc_feature: GZ8MTXP02FJP4X.52.54.E10.1.454.CMB.2.raw
  modified_base (182)..(182): a, c, t, g, unknown or other
  misc_feature (182)..(182): n is a, c, g, or t
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtntcagtgtccccaggacagacggccaggatcacctgctctgganatgcattgccaaaaccgtntatgtacttatagacagacagacggccggccacgtccctgtgtggtgatagtaataagacacgtgacgacggccctacggacggtactccgtagacgtcccgtacttccgtcgtacggtccgtaccgacgggtcgaacggggtaaccgtaacggtacctaacgtacgttacggacctacgtacgtaggtacgggtaacgtaccggaaggtacgaagggaacgggtaacggacggtacgttagtaaactttaagtttaacgtttacgtaacctaaacgtaaccgaaacgtaacgtaaacctaaccgttacgtttacggttaactttagttacggttaccgttaaccggtaacgtaccggaaccggtaaacccgtaaacggttacccgtaacccggttccggtacgggtaacccgaaccggtaacccccgaaaccggtaccccctaaacccgtaccgtacgtacccg

SEQ ID NO: 312483 - DNA, 364 bp, Homo sapiens
  misc_feature: GZ8MTXP02G32JV.52.54.E10.1.454.CMB.2.raw
  modified_base (224)..(224): a, c, t, g, unknown or other
  misc_feature (224)..(224): n is a, c, g, or t
  modified_base (360)..(364): a, c, t, g, unknown or other
  misc_feature (360)..(364): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgganatgcattcgaccaaacgatatgtcttattggtacagcgagaacgccggccacggcccctgtgttggtgatgtaataaagacacgtagacgacgccctagtcgggactccgtgaggccggcgtggcaaggcacatgnnnnn

SEQ ID NO: 312484 - DNA, 555 bp, Homo sapiens
  misc_feature: GZ8MTXP02H2GDA.52.54.E10.1.454.CMB.2.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (342)..(342): a, c, t, g, unknown or other
  misc_feature (342)..(342): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
tcagcgcagtacgacacgaccggtgctcgatttagatcgtagcagacacacaaagggggtgggtccaggaggcagaactctgggtgtctcaccatggcctggatccctctacttcctcccctcctcactctctgcacaggctctgaggcctcctatgagctgacacagcccaccctggtgtcagtcgtccccaggacaggacggccaggatcacctgctctgganatgcattgaccaaacgatntgcttatggtacagcagagccggcaggcccctgtgtggtnatgtaataaagacactggagaggccctagagggaactcccgtgacgccgtattcctgnggtctcgacggtcgaagggacaacggtcactagtcgccatcagtgagtcgagcaggngaacggngctagacttattntagtacaagtcaanagaaccacgtacttaggtaccttagtcgtacgttacgaaactcggtaccaacggtaacgtccaccggttacctgggtaacccaggaccccgaaacggaccctaaccccgacgttcgtacccc

SEQ ID NO: 312485 - DNA, 632 bp, Homo sapiens
  misc_feature: GZ8MTXP02IU0LR.52.54.E10.1.454.CMB.2.raw
  modified_base (492)..(492): a, c, t, g, unknown or other
  misc_feature (492)..(492): n is a, c, g, or t
tcagcgcagtacgacacgaccggtgctcgatttagatcgtagcagaacacacaaaagggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattcgaccaaaccgatatgtcttattggtaccagcaagaacgccggccacggcccctgtgttggtgatgtataaagacagtagagacggtccctgacgggtactccccgtaggacgcccgtaattccgtcgtcgggcctaccgagggtccgaacgggaaccgtaaaccgggtcaaccgtagtttacgggacccaagtcgaaggtcggacgtccgaggacaggaggacgaggctagacgttatttagtgtacaatacaaacngaacaccgtagttacggttacttagtcgttacttacggaacttcggaccgtaaacgtaacggttacccaacccggttccgtacggggttaaccaaccggaccccgaaaacggcccccaaaaccccgtacgtacgtacccg

SEQ ID NO: 312486 - DNA, 605 bp, Homo sapiens
  misc_feature: GZ8MTXP02G9CQH.52.54.E10.1.454.CMB.2.raw
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (255)..(255): a, c, t, g, unknown or other
  misc_feature (255)..(255): n is a, c, g, or t
  modified_base (383)..(383): a, c, t, g, unknown or other
  misc_feature (383)..(383): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgntatgcttatggtacngcagaagccggcaggcccctgtgttggtgatgtataaagacatgagacggccctgaggactccctagagccgattctctggctcgaggtcgagggtacacggtcacagtggaccatcaggtgggtacncgagagacggaggacgtaggactacgtaagtacttaggttctaacaactacaaagacgaacctaacgttaggttaacggttacctttaagtacgttacgttaacggtaaccgttcggaaccggtaaacgtaacgtacccgtaacccgtccgggttacggaaccgacccgtaaacccggaacccggaacccccgttaaacccctacggttaacccgttacccg

SEQ ID NO: 312487 - DNA, 711 bp, Homo sapiens
  misc_feature: GZ8MTXP02GOVL4.52.54.E10.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
tcagcgcagtacgacacgaccggtgctcgatttagatcgtagcagacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaacgntatgtcttagttcggtaccagcaaggaacggcccggccacggcccctggtgttggtgatgtaataaagacagtagaggacggccctcgagggactcccgtaggacgtcccgtattctcgtcggtcctaccggaggtcgagggaccaacggtcacgtagttcggaccagtccgtaggtcgtacggtaccgacggggacgagggaacgggaacggacgggtaccgtagtaaacgtttagtttaagttcggtaactaaaacgttaccaaaacgaacggtaaacctacccgttaagtttaaccggttaactttacggttacgtttaccgtttaaccggtaaacgtttccggtacccggaaaccggttaaacggggtccccctaacccggtttccggtacccgggttaaccgtaacccggtaaccccgaaacccggggaccccctaaaacccctaccgtttacccggtaacccc

SEQ ID NO: 312488 - DNA, 675 bp, Homo sapiens
  misc_feature: GZ8MTXP02IOSPD.52.54.E10.1.454.CMB.2.raw
  modified_base (311)..(311): a, c, t, g, unknown or other
  misc_feature (311)..(311): n is a, c, g, or t
tcagcgcagtacgacacgaccggtgctcgatttagatcgtagcagaacacacaaagggggtgggtccaggaggcagaactctgggtgtctcaccatggcctggatccctctacttcctccccctcctcactctctgcacaggctctgaggcctcctatgagctgacacagccaccctggtgtcagtcgtccccaggacagacggccaggatcacctgctcgtggagatgctattcgacccaaaccgattatgtactttagttcggtaaccagacaggaacggcccgggaccacggcccctggtggttggtnatagtaataaacgacacgtagagacggccctagacgggtactcccgtagacgtcccgtatttccgtcgtcgggtcctacccggagggtccggaaggggaaccctaaaccggggtaccaaccgttagttacgggacctaagtcgacggttagggacgtacccgagggacagggacggacggaggcttagaactttagtttaatcgtaacaatacaaacgacgtaacacgttagttaacggttactttaagtcgttaccgttaacggacgttcggaccgtaaaccgtaacggttccccgaaccggtttcgtacgggtaaccgaaccggacccgaaaccggaccccaacccctacgtacgtaacccg

SEQ ID NO: 312489 - DNA, 563 bp, Homo sapiens
  misc_feature: GZ8MTXP02GDU1R.52.54.E10.1.454.CMB.2.raw
  modified_base (246)..(246): a, c, t, g, unknown or other
  misc_feature (246)..(246): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgaccaaaccgntatgtcttattggtaccagcagaacgccggccagcccctgtgttggtgatgtaataagacactgagacgccctagagggtactcccgtagacgccgtattccgtcgtcggtcctaccgaggtcgaacgggacgaaacggtcaactgtcgctatcgagtggacgtccgaaggcgaggaggacgagactagaacttattagttgactaatacaaacaagacactagttacggtacttagtcgttactacggtactcgacgtaacgacgtcacccgtcgtacggtaacacgaccgaacggacccacccgtactcgtaccc

SEQ ID NO: 312490 - DNA, 719 bp, Homo sapiens
  misc_feature: GZ8MTXP02IDWBO.52.54.E10.1.454.CMB.2.raw
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctcgtggagatgctattcgaccaaaccgatatgcttattggtaccagcagaacgccggccacggcccctgtgttggtgatgtaataaagacacgtgagacggccctagagggactcccgtgacgccgtacttctcgtcggctaccgaggtcgacgggtaacaaccggttacaccgtagttcggacccaagttcgaggttaggacgtacccgagggaccaagggtaacggacggagggtaccgtaggtaacctttaaagttttagtttacggttactaaaacgttaccgaaaacttaacggaaacctaaccgtagttttaacgggtttaactttagttcgtttaaccgtttacggggtaaaaccttcgggaaccgttaaaaccggaaacgggtttcccgtaaccccgggtttccggttacgggggttaacccaacccgggtaacccccgaaaaccggggaacccccctaaaaccccctaaccggtttccggttaaacccccg

SEQ ID NO: 312491 - DNA, 648 bp, Homo sapiens
  misc_feature: GZ8MTXP02HME8A.52.54.E10.1.454.CMB.2.raw
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggactcacctgctcgtggagatgctattgaccaaacgntangcttagtggtaccagcagacgccggccacggccctgtggttggtgagtgtaaanaagacacgagacgacgccgtagacggtactccgtagacgccgtactcgtcgtcgctaccgaggtcgacgggtacgacgacacgtacgtcgactagtacgaggtacggacgtacgaggacgaagggtacggacggtacggtacgtagtaaactttagtttaagttacgtaactaaactaacgaaacgaccgtaaccttaaccgtagtttacgttaacttagtaccgttacgttaaccggacgtacgtaaccgtaaacgtaaccggtacccgtaccggttccggtacggtaacccgaacccggaaacccgtaacccggaaccccgtaaccccgtacgttaccgcccg

SEQ ID NO: 312492 - DNA, 546 bp, Homo sapiens
  misc_feature: GZ8MTXP02F9TZ5.52.54.E10.1.454.CMB.2.raw
  modified_base (537)..(537): a, c, t, g, unknown or other
  misc_feature (537)..(537): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgcttattggtaccagcagaagccggccacggcccctgtgttggtgatgtaataaagacactgagacggccctagagggactccctgagccgtattctcgtggctccgagtcgagggactaacggcacattcggcatcagtggagtccgaggcaggtaggacgaggctgaacttattagttcgtacaatacaacaagacactattagtacttatgtcttacggacttggaccgaacgtaacggtccgaacccgtcgttagggaaccacgacccgaaacggccctaaacccncgtactacc

SEQ ID NO: 312493 - DNA, 608 bp, Homo sapiens
  misc_feature: GZ8MTXP02HFHKQ.52.54.E10.1.454.CMB.2.raw
  modified_base (242)..(242): a, c, t, g, unknown or other
  misc_feature (242)..(242): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccaggcccctgtgttggtgatgtaataaagacactgagacggccctcgagggatccctgagccgtattctctggctccgagggtcagggacaaacggtcactagttggcccatcagtggagtccgaggcaggaggacgaggctggaactatttatgtacaaatccgaaaacacgaacaaccgtagtttacggttaacctttagtacgttaccgtttacgggaaaccgtttgggaccgtaaaccgtaaacgggtacctaaccccggttccgttacgggggtccctaacggacccccgtaaacgggaccccctaaaacccccggcttacggtaaccccg

SEQ ID NO: 312494 - DNA, 640 bp, Homo sapiens
  misc_feature: GZ8MTXP02GN28X.52.54.E10.1.454.CMB.2.raw
  modified_base (223)..(223): a, c, t, g, unknown or other
  misc_feature (223)..(223): n is a, c, g, or t
  modified_base (298)..(298): a, c, t, g, unknown or other
  misc_feature (298)..(298): n is a, c, g, or t
tcagcgcagtacgacacgaccggtgctcgatttagatcgtagcagacacacaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgganatgctattcgaccaaacgtatatgcttatggtaccagctagacgccggcacggcccctgtcgtggtgagtgtaanaagtacactagagacgccctgagggctccgtgacgacccgtatcctcgtaggtcctaccgaggtccgagggaacctacgggtacacgtattcgggacctacgtcgaggttggacgtcccgaagggcgaaggtaggacggtacgggcgtacggtacttacgtttagttcggtaactaacgtaaccaacgaacggaacctaaccgtagtttacggtaacctttaggtacgttacgtacggtaacgtttacgacccggtaaccgaaacggtttccaacccggttcggttacgggaaccctacggaccccgaacggaccccctaaaccccgactttcggtaacccc

SEQ ID NO: 312495 - DNA, 687 bp, Homo sapiens
  misc_feature: GZ8MTXP02JJJ9Q.52.54.E10.1.454.CMB.2.raw
  modified_base (243)..(243): a, c, t, g, unknown or other
  misc_feature (243)..(243): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgntatgcttattggtaccagcagaacgcccggccacggccccctgtgttggtgatgtataaagacacgtggagacggccctgagggactcccgtgagccgtattcctctggcctccgagggtccgaaggggacctaacgggtcaacgtagttcggacccagtcgaggttacggacgttcccgaagggccgaaggaacgggaccggagggtcctaggtaaaccttagtttagttacggtacaaacttacgaaaacacggtaaccaacctaagtttacggttaacctttaagttcgttaccgtttaacgggaacgttacggacccggtaaaccgtaaacgggttccccgtaaaccccggttcccggtttacgggggtaacctaaacccggggtacccccgaaaacggggtaccccccaaaacccccgtaccggttaccttaacccccg

SEQ ID NO: 312496 - DNA, 622 bp, Homo sapiens
  misc_feature: GZ8MTXP02HK7M6.52.54.E10.1.454.CMB.2.raw
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgaccaaaccgatatgcttagttggaccagacagagccggccacggcccctgtgttggtgagtagtaataaacgacacgtggaacgtacggccctagagggactcccgtgacgccgtattcctcgtcgcgtccgaggtcgacgggacaaacggtcaactgtcggaccagtcgaaggtggacgtccgaggcacggaggacgaggtctagtaacttattattacgtacaaacgttacaaacgacgaacctaacctagtttacggttacttaagttcgttaccgttaacggtaaaccttcggaaccgtaaccgtaaacgggtacctaaccggttccgtacggggtaaccaacggaccccgtaaacggacccctaaaccccgtacttccgtaacccg

SEQ ID NO: 312497 - DNA, 647 bp, Homo sapiens
  misc_feature: GZ8MTXP02GJETQ.52.54.E10.1.454.CMB.2.raw
  modified_base (242)..(242): a, c, t, g, unknown or other
  misc_feature (242)..(242): n is a, c, g, or t
  modified_base (289)..(289): a, c, t, g, unknown or other
  misc_feature (289)..(289): n is a, c, g, or t
tcagcgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggccacggcccctgtgtggtnatgtaataaagacactgagacggccctgagggactccctgagccgattcctcgtcggctaccgagggtccgaagggacaacgggttcaaccgtagttcgggaccctaatccgaggtcggacgtcccgaagggaccagggagggaaccgagggtctacggtaattagttaatttggtaactaatacgaaacaacgaacaacccgttagtttacggtaacctttagttacggttaccgttacggtaaaacctgggtacccgtaaaaccgtaacggggttacccaacccgggttcccgtacggggttaaccaaccgtaaccccggaaacggtacccccaaaaccccctccgtagttacccc

SEQ ID NO: 312498 - DNA, 592 bp, Homo sapiens
  misc_feature: GZ8MTXP02GAGQJ.52.54.E10.1.454.CMB.2.raw
  modified_base (244)..(244): a, c, t, g, unknown or other
  misc_feature (244)..(244): n is a, c, g, or t
tcagcgcagtacgacacgaccggtgctcgatttagatcgtagcagaacacacaaaggggggggagcctagctgtgctgtgggtccaggaggcagaactctgggtgtctcaccatggcctggatccctctacttctcccctcctcactctctgcacaggctctgaggcctcctatgagctgacacacgcccacccgtcggtgtcagtcgtccccaggacagacggccaggatcactgctgtgganatgcattcgacccaaaccgatatgtacttagttacggtaccagcagaacgccgggccacggtccctgtgttggtgatagtaataaacgacacgtaggagacccggccctacgacggtactccgtagacgcgtatctcgtcgctcgaggtcgacggacaacggtcatagttcgacatcgtaggtcgacgtacgaggacaggaggacgagtacgtagaacgttattagttgaactaacgtactaaacacggtaaactaccgtagtttacggttaacctttagtcgttaccgttacggtaacgttcggaaccgaaacgtacggtaccgtacccgttcggtacggtaacccg

SEQ ID NO: 312499 - DNA, 630 bp, Homo sapiens
  misc_feature: GZ8MTXP02IU13F.52.54.E10.1.454.CMB.2.raw
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
tcagcgcagtacgacacgaccggtgctcgatttagatcgtagcagaacacacaaagggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcactgctntgganatgcattcgaccaaaccgatatgcttattcggtaccagcaagaacggccggaccacggcccctggtgttggtgatgtaataaagactactgagacggtcctagacgggactcccgagacgccgtattctcgtggcctcgaggtcgagggaacacggtcacgtgtcgcagtcgaggtcgacgtcgagcgaggaggacgagtcgagtaaacttgttagtacgtactaaactacgaaacaacgtactaaccttaagtttacggttaactttacgttacgttacggtttaccggaacgttacggacccgtaaacggtaaaccggttccgtaaacccggtccggttacgggtaaccgaacccgacccggtaaaacccggacccctaaacccccggtactaccgttacccg

SEQ ID NO: 312500 - DNA, 582 bp, Homo sapiens
  misc_feature: GZ8MTXP02J1ZT5.52.54.E10.1.454.CMB.2.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (446)..(446): a, c, t, g, unknown or other
  misc_feature (446)..(446): n is a, c, g, or t
  modified_base (463)..(463): a, c, t, g, unknown or other
  misc_feature (463)..(463): n is a, c, g, or t
  modified_base (573)..(573): a, c, t, g, unknown or other
  misc_feature (573)..(573): n is a, c, g, or t
tcagcgcagtacgacacgaccggtgctcgatttagatcgtagcagaacacacaaagggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatcacctgctcgtgganatgcattcgaccaaacgtntatgcttatggtaccagcagacgccgggccacggcccctgtgtggtgatgtaataaagactacgtgaggacgtccctcgacgggtactcccgtaggacgccgtattctcgtcgcctaccgagtcgagggacacgcatagtcggaccagtcgtaggtcggacgtccgaggcagggaacggcggtaggctagacgtttattntagtacaatacaaacgnaactacctagtttagtaccgtttaatcggttacgtttacggacgttacgaccgtaacgtacgggtaccacccggttcgtcgggaacaccggcccgaaacggcccaacccncggtctacc

SEQ ID NO: 312501 - DNA, 632 bp, Homo sapiens
  misc_feature: GZ8MTXP02H6PEA.52.54.E10.1.454.CMB.2.raw
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (475)..(475): a, c, t, g, unknown or other
  misc_feature (475)..(475): n is a, c, g, or t
tcagcgcagtacgacacgaccggtgctcgatttagatcgtagcagaacacacaaagggggtgggtccaggaggcagaactctgggtgtctcaccatggcctggatccctctacttctcccctcctcactctctgcacaggctctgaggcctcctatgagctgacacagccaccctggtgtcagtcgccccaggacagacggccaggatcacctgctctggagatgcattgaccaaacgatatgcttattgtacagcagaacgcggcagccctgtgttgngatagtanaaagacactaggagcgcctgagggacttcccgagcgccattcctcgtggcctcgacggtcgacgggtaacaacgggtcaacgtacgttcggaccagttcgaaggttcgggacgtacccgaaggggacgaacggacgggacggaacgggtcgtaacgtacgtttaaagtttacgttacggtaacttaanaccgtaaacaacgaacctaaccgtttagtacggtttaactttagtcgttaccgtttacggaacgttagtacccgtaaacggacggtttaccaacccggttcgtacgggtaaccgaccgaacccgtacccgaacccgaacccctacgtaccttacccg

SEQ ID NO: 312502 - DNA, 615 bp, Homo sapiens
  misc_feature: GZ8MTXP02IAUMA.52.54.E10.1.454.CMB.2.raw
  modified_base (109)..(109): a, c, t, g, unknown or other
  misc_feature (109)..(109): n is a, c, g, or t
  modified_base (225)..(225): a, c, t, g, unknown or other
  misc_feature (225)..(225): n is a, c, g, or t
tcagcgcagtacgacacgaccggtgctcgatttagatcgtagcagacacacaaagggggtgggtccaggaggcagaactctgggtgtctcaccatggcctggatccctntacttctccccctcctcactctctgcacaggctctgaggcctcctatgagctgacacagccaccctggtgtcagtcgtccccaggacagacggccaggatcacctgctcgtagganatgctattcggacccaaacgatactgtacttagttcgtaccagcaggaacggccggccgacggcccctgtggttggtgagtgtaagtaaagacataggagacggccctcgaggtacctccgtaggacgccgtacttcgtacgtcggccttaccgacggttcgacgggacgtaaacggtacacgtagttcgactagtgacggttagacgtacaggcgaaggtaggacgagggtctacgtacttacgttaagttacgtactaactacaaacaacgtacaaccgttagtacgttattaagttcgtcgttacgtacgtccgacgtaaaccgtacggtccgtaacgtccgtacggtcgaaccgggacctaccggacctaaccctacgtacgtacc

SEQ ID NO: 312503 - DNA, 551 bp, Homo sapiens
  misc_feature: GZ8MTXP01DWVTM.13.67.G01.1.454.CMB.2.raw
  modified_base (237)..(237): a, c, t, g, unknown or other
  misc_feature (237)..(237): n is a, c, g, or t
  modified_base (360)..(360): a, c, t, g, unknown or other
  misc_feature (360)..(360): n is a, c, g, or t
tcagtcacgtactacacgaccggtgctcgatttagagtatacatattgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaaacaataagaacttcttagcttggtaccagcagaaaccaggacagcctctaagctgctctatttactgggcatctatccgggaatccggggtccccctgaccgatcagtggcnggcgggtctggggacagatttcactctcaccatcagcacgctgcaggctgaagattgggtggtcttagtttattactgtacagtactaagtattaatacgtactcctcgaggtccttcgtacgtttcgggcgggttaacggggacccgtaagggtgggaagaacgtacgaaaacggtaacgttggtaacgg

SEQ ID NO: 312504 - DNA, 525 bp, Homo sapiens
  misc_feature: GZ8MTXP01CY6BG.13.67.G01.1.454.CMB.2.raw
  modified_base (237)..(237): a, c, t, g, unknown or other
  misc_feature (237)..(237): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
tcagtcacgtactacacgaccggtgctcgatttagagtatacatattgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctctaagctgctcatttactgggcatctatccggaatccggggtcccctgacgnttcagtggcngcgggtctggggacagatttcactctcacatcagcagcctgcaggctgaagagtggtgggtctagtttattacgtgtcagactaatattatagtctaacctcgaggtcttcgtacgtttcggacggcggaccgtaaggtaggtaagatacgaaacgtaacgttggtaacg

SEQ ID NO: 312505 - DNA, 543 bp, Homo sapiens
  misc_feature: GZ8MTXP01DUCLM.13.67.G01.1.454.CMB.2.raw
  modified_base (510)..(510): a, c, t, g, unknown or other
  misc_feature (510)..(510): n is a, c, g, or t
  modified_base (517)..(517): a, c, t, g, unknown or other
  misc_feature (517)..(517): n is a, c, g, or t
tcagtcacgtactacacgaccggtgctcgatttagagtatacatattgggtttggggtctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtctgggggaggcttggtacagcctggcaggtccctgagactctcctgtgcagcctctggattcactttgatgattatgccatgcactgggtccggcaagctccgagggggaagggccctgggagtggggtctcgagggtattaggtttaggaaattaggtggtaacgctaagtagggctaagtggcggactctgtgaagggccgattcaccatctccagacgacaacgcaagaacctcctgtatctgacaaatgaacaagcctgagagctaaggaggacaccggcttgtattagttggttanaacaaanctaccaccttagttaagtttggtaag

SEQ ID NO: 312506 - DNA, 542 bp, Homo sapiens
  misc_feature: GZ8MTXP01DFEGF.13.67.G01.1.454.CMB.2.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (361)..(361): a, c, t, g, unknown or other
  misc_feature (361)..(361): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaacaataagaacttctagcttggtaccagcaagaaaccaggacagcctctaagctgctcatttacngggcatctagtccgggaatccggggtccccctgaccgattcagtggcnggcgggtctgggacagactttcactctcacatcagcagcctgcgaggctagaagtagtgggtggtactagtttatacgtgtcagtactaatattatacgtctcctcgaggtcttcgtacgttcgggacggacgggaaccgtaagggtaggaacgtaatacgaaacgtaacgttggtaacgg

SEQ ID NO: 312507 - DNA, 524 bp, Homo sapiens
  misc_feature: GZ8MTXP01B1YOQ.13.67.G01.1.454.CMB.2.raw
  modified_base (237)..(237): a, c, t, g, unknown or other
  misc_feature (237)..(237): n is a, c, g, or t
  modified_base (354)..(354): a, c, t, g, unknown or other
  misc_feature (354)..(354): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctaccaacaataagaacttctagcttggtaccagcagaaaccaggacagcctctaagctgctcatttactgggcatctagtccggaatccggggtcccctgacgatcagtgcngcgggtcgtgggacagtatttcactctcaccatcagcacgcctgcaggctagaagagtggtggtctagtttatactgtcagactaatattatacgtactcctcgaggtcttcgtacgttcggcggagggaccgaagggtggaagactacgaaacgtaacgttggtaacgg

SEQ ID NO: 312508 - DNA, 581 bp, Homo sapiens
  misc_feature: GZ8MTXP01ERZIX.13.67.G01.1.454.CMB.2.raw
  modified_base (238)..(238): a, c, t, g, unknown or other
  misc_feature (238)..(238): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgcaagtccagccagagttgttttanacagcctaccaacaaataagaacttctagctaggtaccagcaagaaaccaggacagccctctaagctgctactatttacgtgggctatctacgtcccgggaaactcccgggggtccccctggaccgtattcaggtcgggcaagggccgggtcgtggggactaggtacttcactctcacctatcagcagcctgcgagcgtagaagatggggtagtacgttagtttacttactgtacaagtactaaattattatacgttacctccttcgacggtcttcgtaccgtttcgggacgggttacgggaccgtaagggtggaacgagtacgaaacggtcgttaaggtcgg

SEQ ID NO: 312509 - DNA, 729 bp, Homo sapiens
  misc_feature: GZ8MTXP01AOQZA.13.67.G01.1.454.CMB.2.raw
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (325)..(325): a, c, t, g, unknown or other
  misc_feature (325)..(325): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccgacggggacatcgtgatgacccagtctccagactccctggctgtgtctcgtggcgagacggccacatcaactgcaagtccagccagtagttgttttanacagctaccaaanaataagtacttntagcttaggaccagacaacgaaaccaggacacgccctactaagctcgactctatttacgngggtactactcgtaacggtcccggggtaacgttccccgggggtacccctacggaccgtagtttccgaggtcgggaccgtaacgggtccgggttcgtacggggtaactaggttaactttcccaacctcctaccgaacctagtccgaaggtcccaacggtccccgtaggaccggaagggtaccgttaagggtaaacggtacggttgggggttcggggttaaacctttaagggtttttaacccttaaggtccggttaaacgtaacgttaaacttaaagttaactttaaccgttaccgtacccgtaaccggtacggttacggttccttacggttaccgggtacggggacgggttaacggttacggtaagggtacgaacgtaacgtaacggaacgtcggttcggtaacg

SEQ ID NO: 312510 - DNA, 504 bp, Homo sapiens
  misc_feature: GZ8MTXP01E4DVV.13.67.G01.1.454.CMB.2.raw
  modified_base (312)..(312): a, c, t, g, unknown or other
  misc_feature (312)..(312): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (477)..(477): a, c, t, g, unknown or other
  misc_feature (477)..(477): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaaacaataagaacttctagcttggtaccagcaagaaaccaggacagcctctaagctgctcattacngggcatctatccggaatccggggtcccctgacgattcagtgcngcgggtntgggacagattcactctcacatcagcagctgcaggctgaagatgggtgctagtttatactgtcagcaatatatgtactcctcgagcttcgtacgttcggcggaggaccgtaaggngaagtatacgaaacgtaacttgtaacg

SEQ ID NO: 312511 - DNA, 706 bp, Homo sapiens
  misc_feature: GZ8MTXP01EQ8EO.13.67.G01.1.454.CMB.2.raw
  modified_base (245)..(245): a, c, t, g, unknown or other
  misc_feature (245)..(245): n is a, c, g, or t
  modified_base (325)..(325): a, c, t, g, unknown or other
  misc_feature (325)..(325): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgaggacgggccaccatcaaactgacaagtccagccagtagttgttttanacagctaccaaacaataagtaacttctagcttggaccagacaagaaaccaggacagcctacaagctgctactatttacgnggactatcgtacgtccgggtaaactccccggggtacccacggtaccgtattcgacggtcggacgtaacgggtccgggttcgtaggggtaacctaggttaactttccaaacccttcctaccaaacccgtataccgaacggacgaaccggtcccgttacggaccggtaaggaccgttaaagggaaaacgttagttccgggggttaaggggttacctttaaagggtttttaacttaacgttcggtaacctaaggtaaaccttaaatttactttaacgtaaccggttacctcccgttacggacgggtccttacgtacggttcgggacgggacggttaaccggtaagggtacgaagttaagaccgaaaacgtcgttcgggtaaccg

SEQ ID NO: 312512 - DNA, 730 bp, Homo sapiens
  misc_feature: GZ8MTXP01ETJ56.13.67.G01.1.454.CMB.2.raw
tcagtcacgtactacacgaccggtgctcgatttagagtatacatattgggtttggggtctgggagaggagccccagccctgagattcccaggtgtttccattcagtgatcagcactgaacacagaggactcaccatggagttgggactgagctggtattttccttttggcttattttagaaggtgtccagtgtgaggtgcaactggtggagtcgtgggggaggcttggtccagccgtgggggtccctgagactctcctgtcagcctcgtgggttcagcttcagtgtatattggatgagctgggtccgccagactccgagggggaaggggcgtgggaggtgggtggaccaaacaataaacacaggaccggaagtcgacccatactaatcgcggtactcgtggtaggaacggggccgtatttaccaccctattccctacccgaaaggacgaaacccaaaaccggcccaaaaggtaacctactaaacttaatttaacttttacggaaccgtaaaagttcggggaacccccgtcgttagggaacggaacggaaccgggaaacgggaaccgtaccggggtaccttaagttagggttaaacttttaacggttgggttccggaacggaaggtaaaggttagttcgggaaagggtgggtttacgggggaacccttaaacggggtcggggggttttaccgggggggggaacccccgggggtttaaaccccgttcggggg

SEQ ID NO: 312513 - DNA, 550 bp, Homo sapiens
  misc_feature: GZ8MTXP01ENAME.13.67.G01.1.454.CMB.2.raw
  modified_base (317)..(317): a, c, t, g, unknown or other
  misc_feature (317)..(317): n is a, c, g, or t
  modified_base (369)..(369): a, c, t, g, unknown or other
  misc_feature (369)..(369): n is a, c, g, or t
  modified_base (432)..(432): a, c, t, g, unknown or other
  misc_feature (432)..(432): n is a, c, g, or t
  modified_base (469)..(469): a, c, t, g, unknown or other
  misc_feature (469)..(469): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctaccaacaataagaacttctagcttggtaccagcaagaaaccaggacagcctacctaagctgctctatttacngggctatctacgtccgggaactcccggggtccccctgacgattcaggtggcnggcgggtcgtgggactagtacttcactctacaccatcagctacgcctgcgaggctagaaagtntggggtggtacttaagtttatactgtcagtactaatnttatacgtctctcgagtcttacgtcgttcgggcggacgggacgtaagggtggaacgtagtacgaaacgtcgttggtaacgg

SEQ ID NO: 312514 - DNA, 525 bp, Homo sapiens
  misc_feature: GZ8MTXP01C425Z.13.67.G01.1.454.CMB.2.raw
  modified_base (238)..(238): a, c, t, g, unknown or other
  misc_feature (238)..(238): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (323)..(323): a, c, t, g, unknown or other
  misc_feature (323)..(323): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (386)..(386): a, c, t, g, unknown or other
  misc_feature (386)..(386): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctacaaacaataagaacttctagcttggtaccagacaagaaaccaggacagcctctaagctgctnatttacnggcatctancggaatccgggtcccngacgatcagtgcngcgggtctgggacagtattcactctcaccatcancacgcctgcagctagaagatgggtggtctagtttatactgtcagactaatattatacgttactcctcgttaggccttctaccgtttcgggacggttgggaccgaagggtgaacgagtacgaaacggtaacttaaggtcg

SEQ ID NO: 312515 - DNA, 611 bp, Homo sapiens
  misc_feature: GZ8MTXP01CTCPN.13.67.G01.1.454.CMB.2.raw
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (327)..(327): a, c, t, g, unknown or other
  misc_feature (327)..(327): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggacggccaccatacaactgacaagtccagccagtagttgtttanacagctaccaaanaataagtaacttctagctaggtaccagacaagaaaccagacacgcctactaagctgcctatatttacgnggactagtcgtacgtaccggaacgtcccggggtaccccctaggacgtagttccgaggtcggcgtaacgggtcgggtcgtaggggactagtactttaccgactcctacacctatacgacgacgacgtccgtagaccgtaggactagaagtagtggggtcgtactttaagtttatacgtgtacgagtaactaatacgttatacgttcctcccgtcgacgtaccttcgtacggttcgggacgggttaggaccgaagggtagaacgtaacgaacgaacgtcgttgtcg

SEQ ID NO: 312516 - DNA, 607 bp, Homo sapiens
  misc_feature: GZ8MTXP01EAEXP.13.67.G01.1.454.CMB.2.raw
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgaggacgggccaccatcaactgcaagtccagccagtagttgtttaanacagcctaccaaanaaataagtacttctagcttacggaccagacaagaaaccaggacacgccctactaagctgtcttactacgtttacgcgggactacgtacgttacggtacccggggtaacgtccccggggtaccccctacggaccgtattcgacggtacgggcgcgggtcgggtacgtacgggactagttactttcaaccttcctaccactacgacgacgtacgacgtcctgacgtacggcgtaagaagtgtggggtagtacgttagtttactntcgtanagtatatatacgtactctcgtcgcgtccttcgtaccggtcggacgggacgacgtaaggagaagtacgtacgagtcgttgtcg

SEQ ID NO: 312517 - DNA, 751 bp, Homo sapiens
  misc_feature: GZ8MTXP01D6JMH.13.67.G01.1.454.CMB.2.raw
  modified_base (253)..(253): a, c, t, g, unknown or other
  misc_feature (253)..(253): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgaggacgggccaaccagtacaaacttgacaaagtccgagccagtagttgtttttaanacagcctaccgaataataagtacttctagcttaggaccagacaacgaaaccaggacacgcctacgtaagcngtctatactttacgnggactacttcgtacgtccgggaacgttcccggggaccctacggacgtacttcgacggtcggacgtaacgggcgggttactggggtaacctacggttaacttttccgaaaccctttcccgtaccgtaacctaacgtaccgtaaacgggccctaaacggtcccgttacgggaccggttaaacgggaccgttaagggtaaaccgttaacggttcgggggttagggtttaaacctttaaggtttttaacgttaaacccgttggtaactaacggttaaccttaaagtttaacgtttaacgtaaccgttccgttaaccctcgggttaaggttccctttacgtaaacggtttcggggaacggttcggggaacccgtaaggggtacgaacgttacgaacgttaaacgtcgttggtaaccg

SEQ ID NO: 312518 - DNA, 636 bp, Homo sapiens
  misc_feature: GZ8MTXP01AXM93.13.67.G01.1.454.CMB.2.raw
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgccgacgggacatcgtgatgacccagtctccagactccctggctgtgtctcgtgggcgaggagggccaccagtcaactgcaagtccagccagtagttgttttanacagcctaccaaanaataagtaacttctagcttaggaccagcaagaaaccaggacagcctacgaagctgctactatttacgtgggctatcttacgtaccggtaacgtcccggggtacccctaggaccgtagttccgaggttacggcgaaggcgggtacgtaggggactagtactttcactctacaccggactacgacgcgtacgcgtcgacgacgacgtagagtagtacggggtacgtacgttacgttacgttacgtacgtacgtacgtaataattaattaacgttacgtaccgtaaccgtacgttacgtacgttaccgttacggtacggttacgggttacggttacggtaacggtacggtaacgtaacgtaacgaacgtaacgttaacggtcg

SEQ ID NO: 312519 - DNA, 545 bp, Homo sapiens
  misc_feature: GZ8MTXP02GAPRM.13.67.G01.1.454.CMB.2.raw
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
tcagtcacgtactacacgaccggtgctcgatttagagtatacatattgggtttggggtctgggagaggagccccagccctgagattcccaggtgtttccattcagtgatcagcactgaacacagaggactcaccatggagttgggactgagctggattttccttttggctatttaaaaggtgtccagtgtgaagtgcagctggtggagtcgtgggggaggcttggtacagcctggcagggtccctgagactctcctgtgcagcctctggattcacctttgatgattatgccatgcactgggtccgnaagctccgaggggaagggcctgggagtggggtctcgaggtattagtggaataggtggtancagtaggctagtgcggactcgtgtagaagggccgagttcaccatctccagagacaacgcaaagacctcctgtatctagacaaatgaacagcctgagagctgacggacacggtcttagtacttaatgtagaactaaaacgtactaacccgaaccccgtttacgtacgttttacggtaagg

SEQ ID NO: 312520 - DNA, 538 bp, Homo sapiens
  misc_feature: GZ8MTXP02IAZJO.13.67.G01.1.454.CMB.2.raw
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (415)..(415): a, c, t, g, unknown or other
  misc_feature (415)..(415): n is a, c, g, or t
  modified_base (440)..(440): a, c, t, g, unknown or other
  misc_feature (440)..(440): n is a, c, g, or t
tcagtcacgtactacacgaccggtgctcgatttagagtatacatattgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgcaagtccagccagagttgtttatacagctaccaacaataagacttctagctggtaccagcagaaaccaggacagcctctaagctgctcatttactgggctatctagtccgggaatccggggtcccctgaccgattcgagtggcngcgggtnggggacagtatttcactctcaccatcagcagcctgcaggctgaagagtggnggtctagtttattactgtacagtanaaattattatacgtacttccgtccgaggcttactaaccgtttcgggaccggtagggaccgtaagggtcggaacgataccgaaaacgtaacgttggcgg

SEQ ID NO: 312521 - DNA, 507 bp, Homo sapiens
  misc_feature: GZ8MTXP02JDSXZ.13.67.G01.1.454.CMB.2.raw
  modified_base (357)..(357): a, c, t, g, unknown or other
  misc_feature (357)..(357): n is a, c, g, or t
  modified_base (412)..(412): a, c, t, g, unknown or other
  misc_feature (412)..(412): n is a, c, g, or t
tcagtcacgtactacacgaccggtgctcgatttagagtatacatattgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttctagcttggtaccagcagaaaccaggacagcctcctaagctgctcatttactgggcatctatccgggaatccggggtcccctgaccgattcagtggcngcgggtctgggacagatttcactctcaccatcagcagcctgcaggctgaagatgnggcagtttattactgtcagcaaatatatagtactcctcgaggctcactttcggacggtaggaccaaggtggaagactacgaaaacgactgtacgg

SEQ ID NO: 312522 - DNA, 542 bp, Homo sapiens
  misc_feature: GZ8MTXP02HJR1X.13.67.G01.1.454.CMB.2.raw
  modified_base (315)..(315): a, c, t, g, unknown or other
  misc_feature (315)..(315): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctaccaaacaataagaacttcttagcttggtaccagcagaaaccaggacagcctctaagctgctcatttacngggcatctagtccggaatccggggtcccctgaccgtatcagtggcnggcgggtnaggganagtnttcactctcacatcagcagcctgcgagctagaagatcgtgtactagtttactactgtcagactaaatattatacgtacctcctacgagtcctactaacgtttcgggacggtacgggaaccgtaagggtagaacgtaactaacgaaacgtaacgttcggtacgg

SEQ ID NO: 312523 - DNA, 521 bp, Homo sapiens
  misc_feature: GZ8MTXP02F52DF.13.67.G01.1.454.CMB.2.raw
  modified_base (237)..(237): a, c, t, g, unknown or other
  misc_feature (237)..(237): n is a, c, g, or t
  modified_base (313)..(313): a, c, t, g, unknown or other
  misc_feature (313)..(313): n is a, c, g, or t
  modified_base (355)..(355): a, c, t, g, unknown or other
  misc_feature (355)..(355): n is a, c, g, or t
  modified_base (409)..(409): a, c, t, g, unknown or other
  misc_feature (409)..(409): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctaccaacaataagaacttcttagcttggtaccagcaagaaaccaggacagcctctaagctgctcatttacngggcatctatccggaatccgggtccctgaccgattcagtgcngcggtctgggacagtattcactctcacatcagcacgcctgcagctagaagatgnggtctagtttatacgtgtacagactaatattagtacgtactctcgagtcctacgacgtttcggacggtacggaaccaaggtacggaagtactacgaaaacgtacgtgtacgg

SEQ ID NO: 312524 - DNA, 554 bp, Homo sapiens
  misc_feature: GZ8MTXP02G5KC8.13.67.G01.1.454.CMB.2.raw
  modified_base (237)..(237): a, c, t, g, unknown or other
  misc_feature (237)..(237): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaaacaataagaacttcttagcttggtaccagcaagaaaccaggacagcctctaagctgctnatttacngggcatctagtccggaatccggggtcccctgaccgtattcgaggtggcaggcgggtactggggacagtactttcactctcacatcagcagccctgcgagctagaagatgtggctagtttacgtactgtacagtacaaattattatacgttactaccgtacgagtcttcgtacgtttcgggaccggtacgggaaccgtaaggggtcggaacgtacgtaaccgaaacggaacgtaggtaccgg

SEQ ID NO: 312525 - DNA, 607 bp, Homo sapiens
  misc_feature: GZ8MTXP02JEXHN.13.67.G01.1.454.CMB.2.raw
  modified_base (421)..(421): a, c, t, g, unknown or other
  misc_feature (421)..(421): n is a, c, g, or t
  modified_base (444)..(444): a, c, t, g, unknown or other
  misc_feature (444)..(444): n is a, c, g, or t
tcagtcacgtactacacgaccggtgctcgatttagagtatacatattgggtttggggtctgggagaggagccccagccctgagattcccacgtgttgccattcggtgatcagcgctgaacacagaggactcgccatggagtttgggctgagcgtggtttccttgtgctatttaaaggtgtccagtgtgaggtgcagctggtagagtcgtgggggaggtgtggtacggccgtggggggtccctcagactctcctgtgcaacctctggattcagatttgatgagtatggcatacacgtggtccgcccaacctccgaggggaaggggctgcagtgggtctctggtataaacgtggaatggtgccagcacaacttatgacagactcgtgtagaaacgggcccgtaattcaccatcctaccagaanacagtcgaccgaagacctccgantccgtagacaaaagtcgaaaacgtgttacgacgggtacgtccggaagggacccaccggggttacctttgggttaaaccctttttcgtaggggttcgtccgggtaaaaggggtttccgacggtaaggttcggtacgttacggtacttacggacgtaacggtcgg

SEQ ID NO: 312526 - DNA, 628 bp, Homo sapiens
  misc_feature: GZ8MTXP02IDF23.13.67.G01.1.454.CMB.2.raw
  modified_base (238)..(238): a, c, t, g, unknown or other
  misc_feature (238)..(238): n is a, c, g, or t
  modified_base (627)..(627): a, c, t, g, unknown or other
  misc_feature (627)..(627): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccaggggacatcgtgatgacccagtctccagactccctggctgtgtctcgtgggcgagagggccaccatcaactgcaagtccagccagagttgtttanacagctaccaaacaataagacttcttagcttaggtaccagacaagaaaccagacagccctacctaagctgctctaatttacgtgggctatctaacgtccgggaagtccggggtccccctagacccgtattccgaggtggccagggtccggggtctacgggggactagggtaacttttccactaccctcaaccctactacgagcctaggccctgaccgagggaccttaggaaagtagttggtagggtacttaaggttttattacgttgttaccagtactaaatttattataacgttaacctccgtaccggcggtacttcgtaaccgtttccggggacggtaacgggtaaccgaagggtacggaagacgtaacgtaaaccgagttacgggng

SEQ ID NO: 312527 - DNA, 607 bp, Homo sapiens
  misc_feature: GZ8MTXP02FQG2F.13.67.G01.1.454.CMB.2.raw
  modified_base (237)..(237): a, c, t, g, unknown or other
  misc_feature (237)..(237): n is a, c, g, or t
  modified_base (313)..(313): a, c, t, g, unknown or other
  misc_feature (313)..(313): n is a, c, g, or t
  modified_base (358)..(358): a, c, t, g, unknown or other
  misc_feature (358)..(358): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctaccaaacaataagaacttcttagcttggtaccagcagaaaccaggacagcctctaagctgctcatttacngggcatctagtccggaagtccggggtcccctgaccattcagtgcnggcgggtctgggacagtatttcactctcaccatcagcacgcctgacgtaggacgtagaaagtgtaggtacggtacgtttaaggtttttaactaccgttaggtacctaggtaacttaaagttaatttaagtacgttaccctacccggttaccgacggtccttacgtaccggtttaccggggaacgggtacgggtaaacccggtaagggtacggaagtaacgtaacgaaaacggtacgtacggttaacggg

SEQ ID NO: 312528 - DNA, 631 bp, Homo sapiens
  misc_feature: GZ8MTXP02ICHXQ.13.67.G01.1.454.CMB.2.raw
  modified_base (289)..(290): a, c, t, g, unknown or other
  misc_feature (289)..(290): n is a, c, g, or t
tcagtcacgtactacacgaccggtgctcgatttagagtatacatattgggtttggggtctgggagaggagccccagccctgagattcccaggtgtttccattcagtgatcagcactgaacacagaggactcaccatggagttgggactgagctggtattttcctttggcttaattttaaaggtgtccagtgtgaagtgcagctgggtgagtcgtgggggagcttggtacagcctggcaggtccctgagactctcctgtcgcagcctcgtggattctacttgatgattannccatgctacgtcgggtccggcaacgctaccggaaggggacgggccgtggaggtgggtctcgaggtattagtggaataggtggtagctagtacgggtctagtcgcgggtacttcgtggtacggacgggtccgtacttccgaacctactccgtaccgaacggaacgaaccaaaccgaaccaaacgaacccttaccgtacgtactactacgaactaaacgacgaaacacgaccgtagaacgacgacgtaggaacggacgtacggtcttaggttacttacgttagtacgaaacgtaaaacgaccttaaccctaacccgtttaacgtttacgttttacggtaacgg

SEQ ID NO: 312529 - DNA, 593 bp, Homo sapiens
  misc_feature: GZ8MTXP02HZK0D.13.67.G01.1.454.CMB.2.raw
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
tcagtcacgtactacacgaccggtgctcgatttagagtatacatattgggtttggggtctgggagaggagccccagccctgagattcccaggtgtttccattcagtgatcagcactgaacacagaggactcaccatggagttgggactgagctggattttcctttggcttattttaaaggtgtccagtgtgaagtgcagctgggtggagtcgtgggggagcttggtacagcctggcaggtccctgagactctcctgtgcagcctgtggattcactttgatgattangccatgcacgtgggccganagctcgagggacggctggngtggtcngtaggttattaggtagatggtgtagcagtgggcttagcgcggtactcgtaggtagaagggccgtagttccaccacttctacccgagacgaacgaaccgaccaaacgtaacctacccgtacgttactcgtacgaacctaaagtacgaaacgacgtccgtagacgacgcgtaggacggaccgtacgtcgttacgttacgttagttacgtagaacgtaaacgtacctaccctaaacccgtttacgtttagtttttacggtaacgg

SEQ ID NO: 312530 - DNA, 563 bp, Homo sapiens
  misc_feature: GZ8MTXP02FS8MM.13.67.G01.1.454.CMB.2.raw
  modified_base (536)..(536): a, c, t, g, unknown or other
  misc_feature (536)..(536): n is a, c, g, or t
tcagtcacgtactacacgaccggtgctcgatttagagtatacatattgggtttggggtctgggagaggagccccagccctgagattcccaggtgtttccattcagtgatcagcactgaacacagaggactcaccatggagttgggactgagctggattttccttttggctattttagaaggtgtccagtgtgaggtgcaactggtggagtcgtgggggaggcttggtccagccgtggggggtccctgagactctcctgtcaagcctctgggttcagcttcagtgtatattggatgagcgtgggtccgccagactccgaggggaaggggctgggaggtggggtggccaacataaacacaggaccggaagtcgacccatactatgcggactcgtgtagagggcgattcacatctcagagaacaacgcccaaagaactcaactattatttgactaaagtgacccgacctgaacgacgacgaggacacggactagtgtaactactggtcgacgagagagtggaagaacgttggacctagnggttcgggggaccggggtaaccctggg

SEQ ID NO: 312531 - DNA, 543 bp, Homo sapiens
  misc_feature: GZ8MTXP02G5CCG.13.67.G01.1.454.CMB.2.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (436)..(436): a, c, t, g, unknown or other
  misc_feature (436)..(436): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaacaataagaacttctagcttggtaccagcaagaaaccaggacagcctactaagctgctctatttacngggcatctagtccgggaatccgggtcccctgaccgtattcgagtgcaggcggtctgggacagtattcactctcacatcagcagccctgcgaggctagaaagntggnggtctagtttatacngtacagactaaattatatacgtaactccgtaccgagtcctcgtacgtttcgggacggtacgggtaaccaaagggtgaacgtactaacgaaaacgtacgtaggtacgg

SEQ ID NO: 312532 - DNA, 554 bp, Homo sapiens
  misc_feature: GZ8MTXP02FJM4T.13.67.G01.1.454.CMB.2.raw
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
tcagtcacgtactacacgaccggtgctcgattagagtatacatattgggtttggggagctacaacaggcaggcagggcagcaagatggtgttgcagaccccaggtctcattctctgttgctctggatctctggtgcccacggggacatcgtgatgacccagtctccagacctccctggctgtgtctgtggcagacggccaccatccaactgcaagtccagccagtagtgtttaanacagctcaaacataagacttctagctggaccagcagaaccnggacagcctcaagctgctcatttacgnggcatcctagtccggggaactcccggggtccccctggacccgattccgaggtcggcagccgggttcnggtacngtattcactctacaccatcancanccctgcaggctaggaactgtgtcgtactagtttacttcgtgtacaagtactaaatattaacgtacgtacctaccgtccggagtccctacgtaaccgttccgggacggtaacggaaccgtaagggtacgacgtacacgtaaaacggactggtcgg

SEQ ID NO: 312533 - DNA, 668 bp, Homo sapiens
  misc_feature: GZ8MTXP02GANIO.13.67.G01.1.454.CMB.2.raw
  modified_base (243)..(243): a, c, t, g, unknown or other
  misc_feature (243)..(243): n is a, c, g, or t
  modified_base (336)..(336): a, c, t, g, unknown or other
  misc_feature (336)..(336): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtcgcccacggggacatcgtgatgacccagtctccagacctccctggctgtgtctcgtgggcgagacgggccaccatcaactgcaagtccagccagtagttgtttanacagctacaaacaaataacgtaacttctagtcttcggtaaccagacaaacgaaaccgaggaacacgcctacctaagctcgctactatttacgnggctattctacgtaccgggaacgtcccggggtacccctcggaccgtagttccgaggtcggcgacggggtccgggtcgtacggggacctagtactttccgactcctaccacctactcgacgcgtacgcctgacgaggcgtagaagtagtcggtagtacgttaaggttttactacgttaggtactacgtaacttaaagttattaaacgtacgttaaccctcccgtaccggtaacgtccgtttaccgttaaccggtttccgggggaccgggaacggggtaaaccggtaaggggtacggaacgtacgtaaaccggtaaaacgtaacgtcggtacgg

SEQ ID NO: 312534 - DNA, 560 bp, Homo sapiens
  misc_feature: GZ8MTXP02IQP7P.13.67.G01.1.454.CMB.2.raw
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
tcagtcacgtactacacgaccggtgctcgatttagagtatacatattgggtttggggtctgggagaggagccccagccctgagattcccaggtgtttccattcagtgatcagcactgaacacagaggactcaccatggagttgggactgagctggattttcctttggctattttaaaggtgtccagtgtgaagtgcagctggtggagtcgtgggggagcttggtacagcctggcaggtccctgagactctcctgtgcagcctctggattcactttgatgattangccatgcacgttgggtccganaagctaccgaggggaacggcctggagtgggtctcgaggtattagttgaatgtggtancagtacggctagtgcggatcgtgtgaggccgtatcacatctccagacgacaacgaccaaagaactccctagtactctgaacaatcgaacagcctagacgagcgtaggacgacgtacggtccttaggttacttagttcgtaagtaacgtaaaacgtactaaccccgtaacccgtttagttaacgtttttaggtaaacgg

SEQ ID NO: 312535 - DNA, 604 bp, Homo sapiens
  misc_feature: GZ8MTXP02HGD05.13.67.G01.1.454.CMB.2.raw
  modified_base (242)..(242): a, c, t, g, unknown or other
  misc_feature (242)..(242): n is a, c, g, or t
  modified_base (335)..(335): a, c, t, g, unknown or other
  misc_feature (335)..(335): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccgacggggacatcgtgatgacccagtctccagactccctggctgtgtctcgtgggcgagacggccaccatcaactgacaagtccagccagagttgttttanacagcctaccaaacaaataagtaacttacttagactttacggtaccagacaagaaaccaggacacgacctctaaacgctcgctctatttacgngggcatctagtccggacgtccggtccccctgaccgtntacagtcgcnggcggtgtggacagtcttcactcncactncacgcacgcctagcacgggntagaaagcgtagtaggtcttaaggtttattaccgtagtaccaagtactaaaatttagttattaacgtccttccgtaccgtaacggtcctacgtaccggtttacggggacgggtaacgggaaccgtaagggttacggaacgtactaaacgaaacccggtaagtcgggtaaccgg

SEQ ID NO: 312536 - DNA, 586 bp, Homo sapiens
  misc_feature: GZ8MTXP02GMN0U.13.67.G01.1.454.CMB.2.raw
  modified_base (288)..(288): a, c, t, g, unknown or other
  misc_feature (288)..(288): n is a, c, g, or t
  modified_base (418)..(418): a, c, t, g, unknown or other
  misc_feature (418)..(418): n is a, c, g, or t
tcagtcacgtactacacgaccggtgctcgatttagagtatacatattgggtttggggtctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagcttggtacagcctggcaggtccctgagactctcctgtgcagcctctggattcacctttgatgattangccatgcacgtggggtccgacaagcctccgaggggaacgggcctggggagtggggtctcgaggttattaggtggaaataggtggtagcagtagggctaagtgacggatcgtgtagagggcgatcacatcnccgagacgacaacgaccaaacgaacctcccgtagtaactcgtacgaactaaagtacgaaacgacgtaccgagaagacgacgtaggaacggacgaccgggtacttacggtacttacgtagtagaacaaaacgtactacccctaacctttacgtaagttttacggtaagg

SEQ ID NO: 312537 - DNA, 574 bp, Homo sapiens
  misc_feature: GZ8MTXP02GAOA6.13.67.G01.1.454.CMB.2.raw
  modified_base (449)..(449): a, c, t, g, unknown or other
  misc_feature (449)..(449): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctaccaaacaataagaacttctagcttggtaccagcaagaaaccaggacagcctcctaagctgctactatttactgggctatctagtccggggaaagtcccggggtccccctgaccgattccgagtcggcgaggtcgggtcgtgggactagtaactttcaccttctccaaccactcgagcgacgccctgcgtaggaccttagaaagtnttggtcggtactaggtttaattacctgtactagactaaattattatacgtacctcgtacgagtcctactacgttcggacggtacggaccgtaaggtcggaacgactaacgaacgaacgtggtacg

SEQ ID NO: 312538 - DNA, 827 bp, Homo sapiens
  misc_feature: GZ8MTXP02JD6UW.13.67.G01.1.454.CMB.2.raw
tcagtcacgtactacacgaccggtgctcgatttagagtatacatattgggtttggggtctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggaggtcttgggtacaggcccgtgggccgtagggtcccctaggacgtacctcctccgtggtcgccaggtccctcgtgggtacttcctaaccgttttgattgtattatcggaccctagttgaccacggttcggggtccccggacaacggtccgtacccggaaggggaacgggtccgtaggggacggtcggggtacctacggtaagggttacgttagggttaggtaaagttagggttagggtaagactaggttacgggcgttaagtcgggaccggtaaccgtttggtagggtacggaacggggtaccggtacttcccgaacctactccgtaccaaggaaacgaacccgaaaccgacccgaaaacggtaaccccttacccgtacggttaacttaccgtacgggaaacccttaaaagaccggtaaaacgaccggtacccgtagggaaacggaaagtccggtaagggaccggtaaaccggtacccggttaccgttttacggtttaaacgtttaacgtttaccgggtaaaacgtaaaaccgttaaaaccgtaacccttaaacccccgttaaaaccccggttttaacggtttaacggttttaacggggtaaacgg

SEQ ID NO: 312539 - DNA, 517 bp, Homo sapiens
  misc_feature: GZ8MTXP02FI3UF.13.67.G01.1.454.CMB.2.raw
  modified_base (235)..(235): a, c, t, g, unknown or other
  misc_feature (235)..(235): n is a, c, g, or t
  modified_base (311)..(311): a, c, t, g, unknown or other
  misc_feature (311)..(311): n is a, c, g, or t
  modified_base (361)..(361): a, c, t, g, unknown or other
  misc_feature (361)..(361): n is a, c, g, or t
  modified_base (417)..(417): a, c, t, g, unknown or other
  misc_feature (417)..(417): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctggcgagagggccacatcaactgcaagtccagccagagtgtttanacagcctccaacaataagaacttcttagcttggtaccagcagaaaccaggacagcctctaagctgctctatttacngggcatctagtccggggaactccggggtccccctgaccgattcagtggcngcgggtctgggacagatttcactctcaccatcagctacgcctgcgaggctagaagntagtggctagtttatactgtacagactaatattactagtacctctcgagctcacgttcggacgaggaccgaaggtacgagactacgaaacgactgtacgg

SEQ ID NO: 312540 - DNA, 595 bp, Homo sapiens
  misc_feature: GZ8MTXP02HX2WG.13.67.G01.1.454.CMB.2.raw
  modified_base (240)..(240): a, c, t, g, unknown or other
  misc_feature (240)..(240): n is a, c, g, or t
  modified_base (324)..(324): a, c, t, g, unknown or other
  misc_feature (324)..(324): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagttgttttanacagctaccaaacaataagtaacttctagcttaggtaccagacaacgaaaccaggacagcctactaagctgactctatttacgngggctatctagtccgggaatcccggggtcccctagaccgtatcgaggtcgctagggcgggtncggggactagtntttcactctacaccatcagcacgcctgacgaggactagaaagtgtacggtaggtacgttagttttataccgtagttaccgaagtattaaacttattaaacgtacgtacctaccgtaccggtacggtaccttacgtaccgtttcgggacgggaacggtacgaaggtcgaacgtacgtaacgaaaaccgtctaggtacg

SEQ ID NO: 312541 - DNA, 591 bp, Homo sapiens
  misc_feature: GZ8MTXP02I654W.13.67.G01.1.454.CMB.2.raw
  modified_base (241)..(241): a, c, t, g, unknown or other
  misc_feature (241)..(241): n is a, c, g, or t
  modified_base (325)..(325): a, c, t, g, unknown or other
  misc_feature (325)..(325): n is a, c, g, or t
  modified_base (357)..(357): a, c, t, g, unknown or other
  misc_feature (357)..(357): n is a, c, g, or t
  modified_base (433)..(433): a, c, t, g, unknown or other
  misc_feature (433)..(433): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccggactccctggctgtgtctcgtgggcgagacgggccaccatcaactgcaagtccagccagagttgttttanacagctaccaacaataagtaacttctagcttaggtaccagacaagaaccaggaccagcctactaaagctcgctactatttacgnggctatctacgtaccgggaactccggggtccncgaccgtattcgagtcgacaggcggggtcagggactagtactttcactcaccacactacagcacgcctgacgacgntacgaagtgtgtagtactagttacttacgtcgtactagactaagttattaactacgtacctaccgtacggtacggtacttacgtaccgttacggggacggtaacgggaccgtaaaggggtcgtaagtacgtaacgaaaacgtacgtaggtacgaaccg

SEQ ID NO: 312542 - DNA, 605 bp, Homo sapiens
  misc_feature: GZ8MTXP02JOFRP.13.67.G01.1.454.CMB.2.raw
  modified_base (268)..(268): a, c, t, g, unknown or other
  misc_feature (268)..(268): n is a, c, g, or t
tcagtcacgtactacacgaccggtgctcgatttagagtatacatattgggtttggggtctgggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggagcttggtacaggccctggcaggtccctgagactctcctgtgcagcctntggattcactttgatgattatgccatgcacgtcgggtccgcaagcctacgaggggaacgggtccgtgggacgtggggtctcgtaggttacgtttaggtaggaataggtggtagctagtaggctagtgacggtactcgtggtagagggtaccctagttaccacctaattcccaccgaaaggacgaacaaccgacctaaaacgacctccctaggtactccgtagacaaagtcaaacgcgtcgagagagctaggaaggtcaccggtctttagtactttagttgtacgtaacaaaacgtaccttaccccgtaaacctttacggtttagttttacggtaagg

SEQ ID NO: 312543 - DNA, 633 bp, Homo sapiens
  misc_feature: GZ8MTXP02HGAT2.13.67.G01.1.454.CMB.2.raw
  modified_base (263)..(263): a, c, t, g, unknown or other
  misc_feature (263)..(263): n is a, c, g, or t
  modified_base (285)..(285): a, c, t, g, unknown or other
  misc_feature (285)..(285): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
tcagtcacgtactacacgaccggtgctcgatttagagtatacatattgggtttggggtctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctctgtgcagcctntggattcacctttgatgattangccatgcacgtgggccgcaagctccgagggacgggctggngtggtcngaggtattagtgaatgtggtagcagtaggctagtgcggtactcgtaggtagaacgggccgtagttccgaacctagtccctaccgaacgaacgaaaccgaaaccgaccaaaacggacccttacccgtagttactcctacggtacaaaatacgaaaccgacgtacccgtaggaagtacgacgtacggaaacggaccgtaccgttaaccttacggttaacgtttagtacggttacgaacgtaaaaacgaccttaaccccgttaaaacccccgtttaacggttaacgtttttagggttaaacggg

SEQ ID NO: 312544 - DNA, 728 bp, Homo sapiens
  misc_feature: GZ8MTXP02HA8MJ.13.67.G01.1.454.CMB.2.raw
  modified_base (248)..(248): a, c, t, g, unknown or other
  misc_feature (248)..(248): n is a, c, g, or t
tcagtcacgtactacacgaccggtgctcgatttagagtatacatattgggtttggggtctgggagaggagccccagccctgagattcccacgtgttgccattcggtgatcagcgctgaacacagaggactcgccatggagtttgggctgagcgtgggttttccttgttgctattttaaaaggtgtccagtgtgaggtgcagctggtagagtcgtgggggaggtggtggtacggccgtgggggtccctnagctctcctgtgcacctgtgattcagtattgatgagtagtggacatacacgtcgggtccacccaaccgtccggaggggacgggtctgcgaggttcgggtctcgtaggtaaataaacgtggtaagtcggggtacaccgagacctaactaaacgttagtcgacaacgtacctcgtagggtaacggaacggggtaccctattacccaaccctactccctaaccgaaggaacgaaccgtacggtaccgggaacccgtaaacggttaaacccttaccccgtaataacgttccgtaggaaaccctaaaagtacgaaaacccgtggttacccggtacggggaacgtaaccgggaaacggaaacccgtccgggtttaccctttaagggtttctttcccgggtaggtacgggtacgggttaaacggtttacggccgttaagggtcgggtacgtttacggttaaccgttacgacgtaaacggttcggggg

SEQ ID NO: 312545 - DNA, 739 bp, Homo sapiens
  misc_feature: GZ8MTXP02JIBOM.13.67.G01.1.454.CMB.2.raw
  modified_base (244)..(244): a, c, t, g, unknown or other
  misc_feature (244)..(244): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatcaactgacaagtccagccaagtagttagtttanacagcctaccaaacaataacgtaaacttcgttaacgcttagggtaccaggtaccaagaaaacccgaggaaccacgccctaccgtaaagcctcgcctactagtttacgtcgggactagtctaacgttaccggggaaacgtcccggggtaccccctcgaccgtattcagggtcgcgacggggtccgggtcggtacgggaacctaggtactttaccgaaccttacctaccgaaccgtatccgaagacccgtaacgtcccgtagtaacccggtaggaccgtaggtaaaggtagttacgggttacggtaccgttaaggttttacttacgttacgttaccgaaggttactaaagtttacttaaacgttacgttacccctttaccggtaccgtacggtaccgttaccggttaaaccggtttccggggaacggggtaccggtaaaccggtaagggtacggaacgttaacgtaaccgtaaaaccggttacgtacggtaaccggg

SEQ ID NO: 312546 - DNA, 623 bp, Homo sapiens
  misc_feature: GZ8MTXP02IQTK6.13.67.G01.1.454.CMB.2.raw
  modified_base (242)..(242): a, c, t, g, unknown or other
  misc_feature (242)..(242): n is a, c, g, or t
  modified_base (337)..(337): a, c, t, g, unknown or other
  misc_feature (337)..(337): n is a, c, g, or t
  modified_base (488)..(488): a, c, t, g, unknown or other
  misc_feature (488)..(488): n is a, c, g, or t
  modified_base (517)..(517): a, c, t, g, unknown or other
  misc_feature (517)..(517): n is a, c, g, or t
tcagtcacgtactacacgaccggtgctcgatttagagtatacatattgggtttgggggagctacaacaggcaggcaggggcagcaagatggtgttgcagacccaggtcttcattttctctgttgctctggatctctggtgcccacggggacatcgtgatgacccagtctccagactccctggctgtgtctcgtgggcgagagggccaccatcaactgcaagtccagccagtagttgttttanacagcctaccaaacaaataagtaaccttcttagacttggtacccagacaagaaaccgaggaccagccctcctaaagctcgccttacacttttacncgggctatccgttaacgtcccggggaaacgttcccggggtcccctacgaccgtattcgaaggttcggctacggggcggggtcctaggggaccaggtaactttcaacgttctacaccactcgacgtcacgcctagctagggctagaacgtancggtggacttagtttatcctagtcaagtntaaattttacgagttccctaccgtcgacgtccttacgttaccgttacgggacgggacggtaaacccgtaagggttcggaagactacgaaaacgtacgtcggtacgg

SEQ ID NO: 312547 - DNA, 738 bp, Homo sapiens
  misc_feature: GZ8MTXP02H1CX6.13.67.G01.1.454.CMB.2.raw
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
  modified_base (318)..(318): a, c, t, g, unknown or other
  misc_feature (318)..(318): n is a, c, g, or t
  modified_base (344)..(344): a, c, t, g, unknown or other
  misc_feature (344)..(344): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccgacggggacatcgtgatgacccagtctccagacctccctggctgtgtctcgtgggcgaggacgggccaccatcaactgacaagtccagccagtagttgtttanacagctaccaanaataagtacttactacgtnttacggaccagacaacgaaaccaggacacgaccctacgtaancctagtcctacttaacgttttaccgngggtacctagttaccgtaaggtaccccggggaacggtttcccccgggggtaccccgtacgaaccccgtagttccgagggttcggacgtcggggtccggggttacgtcgggggaccttaaaggtctttaccaccttcctacccaactactcgaacgccgaacgtcccgtagcgacggtgtaaggagttagtggtacggttagttaacggtttactaccggttatacgaaggttactaaatttaacgttaacgttaccgtacccttacccggttaacggtcgttaccgttaaccgggtttacggtttaccgggggacggggtaacccggtaacggggtaaacggggttcggaaaacgtaccgtaaaaccggtaaaccggtacggtttaggtaccgg

SEQ ID NO: 312548 - DNA, 597 bp, Homo sapiens
  misc_feature: GZ8MTXP02HGE7T.13.67.G01.1.454.CMB.2.raw
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
  modified_base (443)..(443): a, c, t, g, unknown or other
  misc_feature (443)..(443): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccgacgggacatcgtgatgacccagtctccagctccctggctgtgtctcgtgggcgaggacgggccaccatcaactgacaagtccagcagtagttgtttaanacagctaccaaanaataagtacttcttagcttgaccagcaagaaaccngacngcctcagctgctntattcgnggcatctagtccggaacgtccggtccctgaccgtattcgagtcggactgggcgggttngggactagtactttcaccgtccnctacatcacgcgtacncccgtagccgaggactaggaagtatggcgttntagtttacgtagtgactgtaaattaatacgttagtaacttccgtaccgtcggacgtccgttacgtaccggtttacgggggaaccgtacggggtaaaccgtaacggggtaggaaaccgtaacgttaaacccggaaaaggtaccgttaaggtccgg

SEQ ID NO: 312549 - DNA, 703 bp, Homo sapiens
  misc_feature: GZ8MTXP02FYYQ0.13.67.G01.1.454.CMB.2.raw
  modified_base (182)..(182): a, c, t, g, unknown or other
  misc_feature (182)..(182): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
tcagtcacgtactacacgaccggtgctcgatttagagtatacatattgggtttggggtctgggagaggagccccagccctgagattcccaggtgtttccattcagtgatcagcactgaacacagaggactcaccatggagttgggactgagctggattttcctttggcttattttaaaaggngtccagtgtgaagtgcagctggtggagtcgtgggggagcttgggtacagcctggcaggtccctgacnctctctgtgcngcctgtagcttcacttgatgtattangcctagngtaccaggtcggggtcccgagaacggccgtaccggaaggggaccgggtctgggtaggtggtcctgtaagggttactttagggtagtaagtggtggtacncgtaggtagctagacgngtactcgtagggtagaacgggtcctacgtacgaacctacttacccgaccaacggaaacgaacccgaaaaccgtacccggaaaaccgtacccgttacccggtattaaccgttaccaacggtaaaccaaagtaacggaacctcgggaaacccttggaaacggtacggaaccgtgggaaaacccggtacggttaacccggggtactttagggttacttaaacggttgttaaacgaaacgtaaaacgtaccctaacccggttaaccccgttaagtttaaccgtttacggttaaacggg

SEQ ID NO: 312550 - DNA, 706 bp, Homo sapiens
  misc_feature: GZ8MTXP02HJI7X.13.67.G01.1.454.CMB.2.raw
  modified_base (245)..(245): a, c, t, g, unknown or other
  misc_feature (245)..(245): n is a, c, g, or t
  modified_base (339)..(339): a, c, t, g, unknown or other
  misc_feature (339)..(339): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgacaagtccagccagtacgttagtttttanacagcctaccaaacaataacgtacttacttagcttagtaccagacaacgaaaccgaggtacacgcctacctaagctacgactctaagtttacgngggctagtactaacggtccggggtaaacgtcccggggtaccccctacggtaccgtacttacgacggtcggccgtaggggccgggttcggtacggggaaacgtacgtttacgtttaccgtacccttccctacctaacccattaacccgacgggtaccaccggtcccgttacggaccgtacgggaccgttaggaaagtggtttacggtacgggtaactttagtttaacgttaccgttacgacgtaagtactaattaagtttaacgtaacgtacccgttacctaaccggtcggtacctaccggttacgtttacggggacggtaaccggaacgtaaggtacggacgtacgtaacgaaacgtacgttggacg

SEQ ID NO: 312551 - DNA, 626 bp, Homo sapiens
  misc_feature: GZ8MTXP02F8FZW.13.67.G01.1.454.CMB.2.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
tcagtcacgtactacacgaccggtgctcgatttagagtatacatattgggtttgggggagctacaacaggcaggcaggggcagcaagatggtgttgcagacccaggtcttcatttctctgttgctctggatctctggtgcccgaggggacatcggtgatgacccagtctccagacctccctggctgtcgtctcgtgggcgaggacgggccacatcaactgcaagtccagccagtagttntttacacagctaccaaanaataagacttctagcttggaccagcaagaaaccaggacagcctctaanctnctactattcgcggacatctacgccggtactccggggtccccagaccgnttacaggtcgcncggggtcggtactaggggactagtcttacncctactcacntacganccgacgcctacgacgaggtaccgagtaagtagtacggtacggtactttacgtttaaggtttactagggtacctaacggtacgttaaaatttagttaaaccggttactacccgtttaccggacggtacgttccgttaaacgttccggtttacggggacgggtaacggtaaccggaagggtaggaacgacgtacgtaaaacgcggttggtacgg

SEQ ID NO: 312552 - DNA, 733 bp, Homo sapiens
  misc_feature: GZ8MTXP02G6OC3.13.67.G01.1.454.CMB.2.raw
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (292)..(292): a, c, t, g, unknown or other
  misc_feature (292)..(292): n is a, c, g, or t
  modified_base (327)..(327): a, c, t, g, unknown or other
  misc_feature (327)..(327): n is a, c, g, or t
tcagtcacgtactacacgaccggtgctcgatttagagtatacatattggggtttgggggagctacaacaggcaggcaggggcagcaagatggtgttgcagacccaggtcttcatttctctgttgctctggatctctggtgcccaggggacatcgtgatgacccagtctccagactccctggctgtgtcctcgtgggcgaggacgggccaccatcaactgacaagtccagccagagttgtttanacagctaccaaanaatagacttntagcttcggtaccagcaacgaaaccnggaccagccctacctaagctgactactattacggnggtacattacgtacggtaccgggtacggtcccgggtaccctacgtaccgtattacgaggtacggcgcggggtcgggtacggtacggaactacgttacttaccacctacctaccaaacgatacgacgtaccgtacgccgtaggaccgagggtaacctaaggaaacgtcggttacgggtacgttaacgtttaaggttttaccgttaacgtacggtactaaggttaaacttaaaacgtttaagttaaccgttaaccgtaccccggttaccccggtaccggtaaccggttaccttaaccgggttaacccgggttaaccgggggacgggaaaacccgggtacgggtaaaagggggtaccgtaaacggtaaaccgtaaaaccggtaaaacccgggtacggttacggtaccgg

SEQ ID NO: 312553 - DNA, 504 bp, Homo sapiens
  misc_feature: GZ8MTXP01C16MT.22.5.A05.1.454.CMB.2.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (480)..(480): a, c, t, g, unknown or other
  misc_feature (480)..(480): n is a, c, g, or t
  modified_base (491)..(491): a, c, t, g, unknown or other
  misc_feature (491)..(491): n is a, c, g, or t
  modified_base (501)..(501): a, c, t, g, unknown or other
  misc_feature (501)..(501): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggctcccaggctccncatctatgatgcatctacagggccactggcatcccagccaggtcagtggcagtggtcctgggacagacttcaactctcaccatcagcagcctagagcctagaagtattttgactagttttattactgtcagcagcgtaggcaactcctcacgttcggcggaggaccaggtgagatcaaacgacttgtgctgcaccgnttctgtcttcntcttcccgcntcg

SEQ ID NO: 312554 - DNA, 576 bp, Homo sapiens
  misc_feature: GZ8MTXP01DKZFT.22.5.A05.1.454.CMB.2.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (301)..(301): a, c, t, g, unknown or other
  misc_feature (301)..(301): n is a, c, g, or t
  modified_base (392)..(392): a, c, t, g, unknown or other
  misc_feature (392)..(392): n is a, c, g, or t
  modified_base (561)..(561): a, c, t, g, unknown or other
  misc_feature (561)..(561): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccaggggaaanagccacctctcctgcagggccagtcagagtgttaaactactacttagcctggtaaccaanagaaacctggccaggctcccaggctccnatctatgatgcatcttanagggccatggcatcccagccaggttcagtggcaggtggtcctggggacagacttcaactctcaccatcagcagcctagacgctagaaagtnttttgctagttttattactgtcagcagctagggacaacctccctacgaccggttcggacgggacgggaaccgtaagggtggaagacgttaacgaaaaccggtaacgttggagggttcctacggacaacccgttattccttggttccttcgtacttccccgtttaccccnccgttaacgttcccg

SEQ ID NO: 312555 - DNA, 508 bp, Homo sapiens
  misc_feature: GZ8MTXP01EQ25U.22.5.A05.1.454.CMB.2.raw
  modified_base (195)..(195): a, c, t, g, unknown or other
  misc_feature (195)..(195): n is a, c, g, or t
  modified_base (281)..(281): a, c, t, g, unknown or other
  misc_feature (281)..(281): n is a, c, g, or t
  modified_base (341)..(341): a, c, t, g, unknown or other
  misc_feature (341)..(341): n is a, c, g, or t
  modified_base (429)..(429): a, c, t, g, unknown or other
  misc_feature (429)..(429): n is a, c, g, or t
  modified_base (483)..(483): a, c, t, g, unknown or other
  misc_feature (483)..(483): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccaggggaaangccaccctctcctgcagggccagtcagagtgttaactactacttagcctggtaaccaacagaaacctggccaggctcccaggctcncatctatgatgcatcttacagggccatggcatccccagcccaggttcagtgcagtggtcngggacagacttcaactctcaccatcagcagcctagagctagaagtatttgctagttttattactgtcagcagcgtagcaactccctanacgttcggcggtaggaccaggtggagatcaaaacggtacttggtggctgcaccnttctgtcttcatccttccgcaagtc

SEQ ID NO: 312556 - DNA, 500 bp, Homo sapiens
  misc_feature: GZ8MTXP01BKSJB.22.5.A05.1.454.CMB.2.raw
  modified_base (282)..(282): a, c, t, g, unknown or other
  misc_feature (282)..(282): n is a, c, g, or t
  modified_base (350)..(350): a, c, t, g, unknown or other
  misc_feature (350)..(350): n is a, c, g, or t
  modified_base (479)..(479): a, c, t, g, unknown or other
  misc_feature (479)..(479): n is a, c, g, or t
  modified_base (484)..(484): a, c, t, g, unknown or other
  misc_feature (484)..(484): n is a, c, g, or t
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
tcagacatacgcgtcacgaccggtgctcgatttagatagatagacagggggaggaactgctcagttaggacccagagggaaccatggaagcccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctccncatctatgatgcatcttacagggccactggcatcccagccaggttcagtgcagtgggtcctggggacngacttcaactctcaccatcagcagcctagagctgaagtatttgctagtttatactgtcagcagcgtagcaactcctcacgttcggcggagggaccaaggtggagatcgaaacgaacttgtggctgcacnttctntctcntcttccncntn

SEQ ID NO: 312557 - DNA, 511 bp, Homo sapiens
  misc_feature: GZ8MTXP01APX7Q.22.5.A05.1.454.CMB.2.raw
  modified_base (196)..(196): a, c, t, g, unknown or other
  misc_feature (196)..(196): n is a, c, g, or t
  modified_base (350)..(350): a, c, t, g, unknown or other
  misc_feature (350)..(350): n is a, c, g, or t
  modified_base (392)..(392): a, c, t, g, unknown or other
  misc_feature (392)..(392): n is a, c, g, or t
  modified_base (485)..(485): a, c, t, g, unknown or other
  misc_feature (485)..(485): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggctcccaggctcctcatctatgatgcatctacagggccactggcatcccagccaggttcagtggcagtgggtcctgggacngacttcaactctcaccatcagcagcctagacgcctagaagtnttttgctaagtttattactgtcagtcagcgtagcaactccctacacgttcggcggaggaccaggtcggagatcaaagacttggtgctgcacgnttctgtctcactcttcccgcttctcg

SEQ ID NO: 312558 - DNA, 510 bp, Homo sapiens
  misc_feature: GZ8MTXP01DF4UL.22.5.A05.1.454.CMB.2.raw
  modified_base (193)..(193): a, c, t, g, unknown or other
  misc_feature (193)..(193): n is a, c, g, or t
  modified_base (252)..(252): a, c, t, g, unknown or other
  misc_feature (252)..(252): n is a, c, g, or t
  modified_base (351)..(351): a, c, t, g, unknown or other
  misc_feature (351)..(351): n is a, c, g, or t
  modified_base (485)..(485): a, c, t, g, unknown or other
  misc_feature (485)..(485): n is a, c, g, or t
  modified_base (507)..(507): a, c, t, g, unknown or other
  misc_feature (507)..(507): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtcttgtctccaggggaanagccaccctctcctgcagggccagtcagagtgttaactactacttagcctggtaccaanagaaacctggccaggctcccaggctcctcatctatgatgcatcttacagggccactggcatccccagcccaggttcagtggcagtgggtcctggggacngacttcaactctcacatcagcagcctagacgcctgaagattttgactagttttattactgtcagcagctaggcaactccctcgacgttcggcggaggaccaagggtgagatacaaacgaacttgtgcgtgcacnttctgtcttcatccttcccgcntcg

SEQ ID NO: 312559 - DNA, 521 bp, Homo sapiens
  misc_feature: GZ8MTXP01BCVT3.22.5.A05.1.454.CMB.2.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
  modified_base (350)..(350): a, c, t, g, unknown or other
  misc_feature (350)..(350): n is a, c, g, or t
  modified_base (490)..(490): a, c, t, g, unknown or other
  misc_feature (490)..(490): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccaccctctcctgcagggccagtcagagtgttaactactacttagcctggtaccaacagaaacctggccaggctccaggctccncatctatgatgcatcttacagggccactggcatcccagcccaggttcagtgcaggtgggtcctgggacngacttcaactctcaccatcagcagcctagacgctgaagtattttgctagtttattactgtcagcagcgtaggcaactccctcacgttcggcggaggaccaaggtggagatcgaaaacgacttaggtcggctggcttacgnttctgtcttcattccttcccgcttaagtccg

SEQ ID NO: 312560 - DNA, 568 bp, Homo sapiens
  misc_feature: GZ8MTXP01A3M1I.22.5.A05.1.454.CMB.2.raw
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
  modified_base (340)..(340): a, c, t, g, unknown or other
  misc_feature (340)..(340): n is a, c, g, or t
  modified_base (524)..(524): a, c, t, g, unknown or other
  misc_feature (524)..(524): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtcttgtctccgaggggaaangccaccctctcctgcagggccagtcagagtgttaactactacttagcctggtaccaanagaaacctggccaggctcccaggctccnatctatgatgctatctacagggccatggcatcccagccaggttcaggtgcaggtggtcngggacagacttcaactctcacatcagcagcctagacgctagaagtatttgacttagtttattacgtgtacagcagtcgtaggctaacgtccctacgtacggttcgggacggtaacgggaaccgaagggtaggaacgtaacgtaacgaaaacggtaacgttgggtacggctacggaccaccgttnttccgttcgtcttccgtacttcccgttacccgtcttaacttccg

SEQ ID NO: 312561 - DNA, 549 bp, Homo sapiens
  misc_feature: GZ8MTXP01BI0K4.22.5.A05.1.454.CMB.2.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (386)..(386): a, c, t, g, unknown or other
  misc_feature (386)..(386): n is a, c, g, or t
  modified_base (512)..(512): a, c, t, g, unknown or other
  misc_feature (512)..(512): n is a, c, g, or t
  modified_base (532)..(532): a, c, t, g, unknown or other
  misc_feature (532)..(532): n is a, c, g, or t
tcagacatacgcgtcacgaccggtgctcgatttagatagatagacagggagaggaactgctcagttaggacccagagggaaccatggaagccccagctcagcttctcttcctcctgctactctggctcccagaaaccaccggagaagttgtgttgacacagtctccagccaccctgtctttgtctccgaggggaaangcccaccctctcctgcagggccagtcagagtgttaactactacttagcctaggtaccaanagaaacctggccaggctcccaggctcctcatctatgatgcatctacgaggccatggcactcccagcctaggttcagtggcaggtcgggtctgggacagtacttcactctacaccatcagcagcctagcnctagaagtatttgactagtttatctgtacagcagcgtacgactaacctccgtcgtaccggttcgggcgggtaacgggaccgtaagggtcggaagactaacgaaacgttacgtgcgggtctggaccnccttattccgtgtccttacncttccttcccgctaacg

SEQ ID NO: 312562 - DNA, 495 bp, Homo sapiens
  misc_feature: GZ8MTXP01BLG8E.22.5.A05.1.454.CMB.2.raw
  modified_base (194)..(194): a, c, t, g, unknown or other
  misc_feature (194)..(194): n is a, c, g, or t
  modified_base (280)..(280): a, c, t, g, unknown or other
  misc_feature (280)..(280): n is a, c, g, or t
  modified_base (378)..(378): a, c, t, g, unknown or other
  misc_feature (378)..(378): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccaggggaangccaccctctcctgcagggccagtcagagtgttaactactacttagcctggtaccaacagaaacctggccaggctcccaggctccncatctatgatgcatcttacagggccatggcatcccagccaggttcagtggcagtgggtcctggggacagacttcaactctcaccatcagcagcctagngcctgaagatttgctagtttattactgtcagcagcgtaggcaactcctcacgttcggcggaggaccaggtgagatcaaacgattgtgctgcacgnttctntctcnctcttccncntc

SEQ ID NO: 312563 - DNA, 493 bp, Homo sapiens
  misc_feature: GZ8MTXP01EMQNL.22.5.A05.1.454.CMB.2.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
  modified_base (371)..(371): a, c, t, g, unknown or other
  misc_feature (371)..(371): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (447)..(447): a, c, t, g, unknown or other
  misc_feature (447)..(447): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccaggggaaanagccaccctctcctgcagggccagtcagagtgttaactactacttagcctggtaaccaacagaaacctggccaggctcccaggctcncatctatgatgcatctacaggccatgcatccagccagttcagtgcagtggtctgggacagacttcaactctcacatcagcagcctaganctagaagtatttgctagtttattactgtcagcagcgtagcaactcccngacgtcggnggaggacaggtgagactanaaacgacttgtgctgcacgttnttctgtctcnctcttcctcttgtc

SEQ ID NO: 312564 - DNA, 611 bp, Homo sapiens
  misc_feature: GZ8MTXP01D2ZXL.22.5.A05.1.454.CMB.2.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
  modified_base (418)..(418): a, c, t, g, unknown or other
  misc_feature (418)..(418): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccagggggaaancgcccaccctctcctgcagggccagtcagagttgttaaactactacttagcctaggtaaccaacagaaacctggaccaggcctcccaggctcctnatctatgatgctatctacngggccagtgcatcccagccagtcagtgcagtggtcngggacagcttnaactcncacntcagcagcctagacnctagaacgtntttgacttaaggtttattactggtnaacgtcaagtcgtaggacctaaccttcccctacgtaaccgggttccgggacggggacgggtaacccgtaaggggtggaaacgtacgtaacgaaaacgggtacgttagggtcgccgtcggaccttaaacgttcttaccgttcggttccttaaccgttaccgttccctttacccccggccgttaactttcccggg

SEQ ID NO: 312565 - DNA, 555 bp, Homo sapiens
  misc_feature: GZ8MTXP01ANDR0.22.5.A05.1.454.CMB.2.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanagccaccctctcctgcagggccagtcagagtgttaactactacttagcctggtaccaanagaacctggccaggctcccaggctccncatctatgatgcatcttacgagggccatggcatcccagccaggttcagtggcaggtgggtctggggacagtaccttcaactctcaccatcagcagcctagacgcctagaagtatttgcttagtttattactgtacagcagcgtaggctaaccttccctacgtacggttcgggcggacgggaccgaagggtgggaacgatacgaaacgtaacgttggtcggcgtggaccttacgttattcttaagtccttctacttccttcccgcttcgtccg

SEQ ID NO: 312566 - DNA, 543 bp, Homo sapiens
  misc_feature: GZ8MTXP01BXY7D.22.5.A05.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaangccaccctctcctgcagggccagtcagagtgttaaactactacttagcctggtaccaacagaaacctggccaggctcccaggctccncatctatgatgcatcttacagggccactggcactccccagccctaggttcaggtggcaggtcggggtctggggacagacttcaactctcaccatcagcagctagagcctgaagtattttgacttagtttattacttcgtcagcgtagcgttaggctaacctccctctacgttcgggcggtaggaccgaggtggagtactcgaaacgacttggtggcgtgcaccttgttctgtcttcacttccttcccgtcttaactccg

SEQ ID NO: 312567 - DNA, 524 bp, Homo sapiens
  misc_feature: GZ8MTXP01EWHTB.22.5.A05.1.454.CMB.2.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
  modified_base (411)..(411): a, c, t, g, unknown or other
  misc_feature (411)..(411): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccaccctctcctgcagggccagtcagagtgttaactactacttagcctggtaaccaacagaaacctggccaggctccaggctccncatctatgatgcatctacagggccactgcatcccagccagttcagtgcagtggtcctggggacagacttcaactctcaccatcagcagcctagagctgaagtatttgactagtttacttactgtacagnagtacgtaggactaacgtccctcgacgttcggacggtaggaccgtaaggtgagatacaaagaacttggaggttcgngacncgttnttctntctctctccttccctcttcgtcg

SEQ ID NO: 312568 - DNA, 547 bp, Homo sapiens
  misc_feature: GZ8MTXP01AJ8KL.22.5.A05.1.454.CMB.2.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (373)..(373): a, c, t, g, unknown or other
  misc_feature (373)..(373): n is a, c, g, or t
  modified_base (397)..(397): a, c, t, g, unknown or other
  misc_feature (397)..(397): n is a, c, g, or t
  modified_base (502)..(502): a, c, t, g, unknown or other
  misc_feature (502)..(502): n is a, c, g, or t
  modified_base (516)..(516): a, c, t, g, unknown or other
  misc_feature (516)..(516): n is a, c, g, or t
  modified_base (543)..(543): a, c, t, g, unknown or other
  misc_feature (543)..(543): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaanagaaacctggccaggctcccaggctccncatctatgatgcatcttacagggccacgtggcatccccagcccaggttcagtggcaggtgggtcctggggacagacttcaactctcaccntcagcagcctagacgctagaagtnttttgacttagtttattactgttcagtcagtcgtacgggctaacctccctacgaccggttcgggacgggtagggaccgaggtggagactacaaacgaacgttggngggctgcaccgttnttctgttcttctctccttcccgccttntccg

SEQ ID NO: 312569 - DNA, 556 bp, Homo sapiens
  misc_feature: GZ8MTXP01CNJND.22.5.A05.1.454.CMB.2.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (349)..(349): a, c, t, g, unknown or other
  misc_feature (349)..(349): n is a, c, g, or t
  modified_base (528)..(528): a, c, t, g, unknown or other
  misc_feature (528)..(528): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgctccgaggggaaangccaccctctcctgcagggccagtcagagtgttaaactactacttagcctaggtaaccaacagaaacctggccaggctcccaggctcncatctatgatgcatctacgagggccagtgcatcccagccaggtcaggtgcaggtggtcctggganagacttcactctcacatcagcacgcctaagacgtcctaggtaagtagtttcgacttaagttttattactgtcagcagtcgtacggctaacctcccgtacgtacggttcgggacggacggaaccgaagggtgagtataacgaaacgtaacgttggtggcgtacgcttacttacttcgttntaccttcacttccttcccgcttctaacg

SEQ ID NO: 312570 - DNA, 574 bp, Homo sapiens
  misc_feature: GZ8MTXP01DNLM7.22.5.A05.1.454.CMB.2.raw
  modified_base (198)..(198): a, c, t, g, unknown or other
  misc_feature (198)..(198): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (347)..(347): a, c, t, g, unknown or other
  misc_feature (347)..(347): n is a, c, g, or t
  modified_base (401)..(401): a, c, t, g, unknown or other
  misc_feature (401)..(401): n is a, c, g, or t
  modified_base (539)..(539): a, c, t, g, unknown or other
  misc_feature (539)..(539): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgagggggaaanagcccaccctctcctgcagggccagtcagagtgttaactactacttagcctaggtaccaacagaaacctggaccaggcctccaggctcctnatctatgatgcatctacgnggccatggcatcccagcctaggtcagtgcaggtggtccngggacagtaccttcaacctctcacatcacgcaggcctaagacgtcctagaagtnttttagacttaagtttattactgtacagtcaagtcgtacggacctaaccttccctcgtacggttccgggacggtacgggaaaccgaagggtacggagtacgtaacgaaacgtacgttcggtggcgttcgacaccgttnttacgtctacttctactccttccctcttcgtaacg

SEQ ID NO: 312571 - DNA, 539 bp, Homo sapiens
  misc_feature: GZ8MTXP01EZL33.22.5.A05.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (505)..(505): a, c, t, g, unknown or other
  misc_feature (505)..(505): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanagccaccctctcctgcagggccagtcagagtgttaactactacttagcctggtaccaacagaaacctggccaggctcccaggctccncatctatgatgcatcttacaggggccactggcatcccagccaggttcagtgcagtggtcctgggacagcttcaactctcaccatcagcagcctagacgctagaagtatttgcttaagtttattactgtcagcagcgtaggctaacctccctcgacggttcggcgggtagggaccaaggggtcggagacgtacgaaacgtaacgttggtcggcgtgcaccgnttctgttcttctacttccttcccgcttaattccg

SEQ ID NO: 312572 - DNA, 606 bp, Homo sapiens
  misc_feature: GZ8MTXP01BOJ2B.22.5.A05.1.454.CMB.2.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (405)..(405): a, c, t, g, unknown or other
  misc_feature (405)..(405): n is a, c, g, or t
  modified_base (557)..(557): a, c, t, g, unknown or other
  misc_feature (557)..(557): n is a, c, g, or t
tcagacatacgcgtcacgaccggtgctcgatttagatagatagacaggggggaggaactgctcagttaggacccagagggaaccatggaagccccagctcagcttctcttcctcctgctactctggctcccagaaaccaccggagaagttgtgttgacacagtctccagccacctgtctttgtctccgaggggaaancgcccaccctctcctgcagggccagtcagtagtgttaactactacttagcctggtaaccaacagaaacctggccaggctccaggctcncatctatgatgcatcttacgagggccagtcggacactcccagccaggttcagtggcaggtgggtcctggggacagtacttcgaacttctcaccatcagcagcctagacgactaggaagtntttagcttagtttacttacgtgtacagtcgagtcgtacggtacctaaaccttccccgtacgtaaccgggttcggggaccgggtacgggaaccggaagggtgggaagtaacgtaacgaaacggtaacgttggtcggcgtacggcttaccgttnttccgttcggtacttcgtaccttcccgttcccgtccttaacgttaaccg

SEQ ID NO: 312573 - DNA, 654 bp, Homo sapiens
  misc_feature: GZ8MTXP01AJ5M6.22.5.A05.1.454.CMB.2.raw
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaangcccaccctctcctgcagggccagtcagtagtgttaactactacttagcctaggtaccaanagaaacctggccaggcctcccgaggctcncatctatgatgctatcttacgacgggccacgtggcacgtccccgagcccgtaggttccaggtggcgaggttcggggtcctggggacaggtacttcaacttcctccacatcgagcacgcctagacgtctaggaagtatttgacttagtttacttactgtactagacgtagtaccgtaacgggtacctaacccgttcccgtaccgtaccgggttcggggacgggtaacggggaaccgtaaggggtacggaacgtaaccgtaacggaaaaccggtagttacggtcggaccgtacgacccttaccgttagttcccggttctttcccttaacgttacccttccccgttaccccgtccttaacgtttaacccg

SEQ ID NO: 312574 - DNA, 608 bp, Homo sapiens
  misc_feature: GZ8MTXP01CN185.22.5.A05.1.454.CMB.2.raw
  modified_base (198)..(198): a, c, t, g, unknown or other
  misc_feature (198)..(198): n is a, c, g, or t
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaaggggaaanacgccaccctctcctgcagggccagtcagtagtgttaactactacttagcctaggtaaccaanagaaacctggaccaggcctcccgaggtctcctnatctatgatgcatctacgagggccactggcactcccagcctaggtcagtggcaggtcgggtcctggggaacngtacttcaactctcacctancacgacacgtacagactacgtagtaagttgtttcgactttaagttttactacgtgtacgagtcgacgtacgtacgtaccctaaccgtcccgtacggtacgggtacgggacggaacgggaacgtaagggtacgaacgtaacgtaacgaaacggtacgttgggtacgcgtacgaccttacgttcttcgttcttccttctacttcccgttacccgcttaacgtcg

SEQ ID NO: 312575 - DNA, 663 bp, Homo sapiens
  misc_feature: GZ8MTXP01DRGDE.22.5.A05.1.454.CMB.2.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (346)..(346): a, c, t, g, unknown or other
  misc_feature (346)..(346): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaangccaccctctcctgcagggccagtcagagtgttaactactacttagcctggtaaccaacagaaacctggaccaggcctcccaggcctccncatctatgatgcatctacgacgggccactggccatccccagccctaggttcaggtggcnggtgggtctggggacagtactcaactctcacatcagcagcctagacgtcctaggaacgttatttgacttaagtttacttacgtgtacgagctaaggtccgtaacggtaccctaaaccctttccccgtacgtaccgggtttcccggggacgggttaaacgggggaaccctaaagggggtggtaaacggtaactaccggtaaaaaacggtaaccgttgggttacggccgttacgggacccttaaaccgttacgtttcccgtttcggttaccttttccggtaaccgtttccccttttaccccgggccttaacgtttcccg

SEQ ID NO: 312576 - DNA, 567 bp, Homo sapiens
  misc_feature: GZ8MTXP01D1K75.22.5.A05.1.454.CMB.2.raw
  modified_base (200)..(200): a, c, t, g, unknown or other
  misc_feature (200)..(200): n is a, c, g, or t
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (370)..(370): a, c, t, g, unknown or other
  misc_feature (370)..(370): n is a, c, g, or t
  modified_base (417)..(417): a, c, t, g, unknown or other
  misc_feature (417)..(417): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
  modified_base (537)..(537): a, c, t, g, unknown or other
  misc_feature (537)..(537): n is a, c, g, or t
  modified_base (555)..(555): a, c, t, g, unknown or other
  misc_feature (555)..(555): n is a, c, g, or t
tcagacatacgcgtcacgaccggtgctcgatttagatagatagacagggggaggaactgctcagttaggacccagagggaaccatggaagccccagctcagcttctcttcctcctgctactctggcctcccagaaaccaccggagaagttgtgttgacacagtctccagccaccctgtctttgtctccgaagggggaaancgcccaccctctcctgcagggccagtcagtagttagttaaactactacttagcctaggtaaccaaacagaaacctgggaccaggcctcccgaggcctcctnatctatgatgctattctacgngggccagtcggcactcccagccctaggttcaggtgcgaggtgggtccngggacagtcttcaactctcacatcagcacgctagagtctagtaactntttagacttaagtttattactgtacagtcaagcgtacggactaaccgtccctacgacggtcggacgggacggaacgaggtcggatagtacgaaagcgnggtgcngacttaccgattcgtntacttctactccgttccncttaattaaccg

SEQ ID NO: 312577 - DNA, 601 bp, Homo sapiens
  misc_feature: GZ8MTXP01ELDM2.22.5.A05.1.454.CMB.2.raw
  modified_base (198)..(198): a, c, t, g, unknown or other
  misc_feature (198)..(198): n is a, c, g, or t
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (550)..(550): a, c, t, g, unknown or other
  misc_feature (550)..(550): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgttctttgtctccgaggggaaancgcccaccctctcctgcagggccagtcagagtgttaactactacttagcctaggtaaccaanagaaacctggccaggcctcccaggctccnatctatgatgctatctacgagggccagtggcactccccagcccaggttcagtggcaggtgggtcctgggacagtacttcaactctcacatcagcagcctagngctagaagtntttgacttagtttattactgtacagcagtcgtaggactaaccttcccctacgtacggttccgggacgggtaacggggaaccgtaaggggtaggaagtaacgtaacgaaaaacggtacgttgggtacggttcgtacggacttacccgttnttccgttggttccttaactacgttcccgttccccgtccgttaacgttcccg

SEQ ID NO: 312578 - DNA, 576 bp, Homo sapiens
  misc_feature: GZ8MTXP01A0H7P.22.5.A05.1.454.CMB.2.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (389)..(389): a, c, t, g, unknown or other
  misc_feature (389)..(389): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaanagaaacctggccaggctcccaggctccnatctatgatgcatctanggccatggcatcccagccaggttcagtggcaggtgggtcctggggacagtacttcaactctcaccatcagcagcctagacgctgaagtntttgactagtttatactgtcagcagtcgtaggctaactccctacgtaccggttcggacggtacgggaccgaagggtcggaagtacgtacgaaaacggtaacgttgggtacggcgtacggccttacccgttgttaccgttcggttcctttaacctactttccccgtttccccggccttaacgtttccg

SEQ ID NO: 312579 - DNA, 602 bp, Homo sapiens
  misc_feature: GZ8MTXP01DOC7M.22.5.A05.1.454.CMB.2.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (334)..(334): a, c, t, g, unknown or other
  misc_feature (334)..(334): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagcccaccctctcctgcagggccagtcagagtgttaactactacttagcctggtaccaacagaaacctggccaggctcccaggctccnatctatgatgcatctacagggccagtggcatcccagccaggttcagtgcnggtggtctgggacagacttcaactctcacatcagcagcctagacgcctagtaagtattttgacttaagttttattactgtacagcaagtcgtaggcctaaccttccctacgtaccggttcgggacgggacgggaaccgaagggtcggaagtaactacgaaaacgtacgttaggtcggacgtacggccttaacccgttagtttccgttcgtttaccctttaaccgttaaccgttcccctttaccccggtcccgttaacgtttaacccgg

SEQ ID NO: 312580 - DNA, 560 bp, Homo sapiens
  misc_feature: GZ8MTXP01DI3PO.22.5.A05.1.454.CMB.2.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccaccctctcctgcagggccagtcagagtgttaactactacttagcctggtaaccaacagaaacctggccaggcctccaggctccnatctatgatgcatctacgnggccatggcatcccagcccaggttcaggtgcaggtggtcctggggacagtaccttcaactctcacntcagcagccagnctagagtntttgactagtttatactgtcagcagcgtaggacctaacctccctacgaccggttcgggcgggtacgggaaccgtaagggtggaagacgtaacgaaaacggtacgttggtacggctacggcttaaccgttattccgtgttccttctacttcccttaccccgcttaacgttccg

SEQ ID NO: 312581 - DNA, 568 bp, Homo sapiens
  misc_feature: GZ8MTXP01CGBDZ.22.5.A05.1.454.CMB.2.raw
  modified_base (195)..(195): a, c, t, g, unknown or other
  misc_feature (195)..(195): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (341)..(341): a, c, t, g, unknown or other
  misc_feature (341)..(341): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccgaggggaangccaccctctcctgcagggccagtcagagtgttaaactctacttagcctggtaaccaacagaacctggccaggctcccaggctccncatctatgatgcatctacgngggccacgtggcatcccagccaggttcagtgcagtggtcngggacagcttcactctcaccatcagcagcctagacgtcctagaacgttatttttacgagttttattacttgtcagcagtcgtacgtactaaccttcccgtccgtacggttcgggacgggacgggaccgaagggtggaagtacgtacgaaaacggtcgtaggttcggcgttcgacaccttattcgttcgttccttcaacttcctccccgttctaacgttcgtaaccgg

SEQ ID NO: 312582 - DNA, 562 bp, Homo sapiens
  misc_feature: GZ8MTXP01D39ZY.22.5.A05.1.454.CMB.2.raw
  modified_base (193)..(193): a, c, t, g, unknown or other
  misc_feature (193)..(193): n is a, c, g, or t
  modified_base (276)..(276): a, c, t, g, unknown or other
  misc_feature (276)..(276): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtcttgtctccaggggaangtcaccctctctgcaggccagtcagagtgttaactactacttagcctaggtaccaacagaaacctggtcaggctccaggctcnatctatgatgacatcgttaacgacgggccacgtcggccatccccgagccctaggttcaggtcgacgaggtcggtctggggacagtactcaactctcacatcagcagcctagactctagaagtatttgactaagtttattactgtcagcagtcgtagacctaactccctcgaccgtcggcggaggaaccgagggtacggagtacgtacgaaaacgtagttggacggacgtcggaccaccgttattcttgttccttaacttacttcccgttccctccgttaatttccg

SEQ ID NO: 312583 - DNA, 539 bp, Homo sapiens
  misc_feature: GZ8MTXP01E0SYX.22.5.A05.1.454.CMB.2.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanagccaccctctcctgcagggccagtcagagtgttaactactacttagcctggtaccaanagaacctggccaggctccaggctcnatctangatgcatctacngggccagtgcatcccagcccaggttcagtgcaggtggtctggggacagacttcaactctcaccatcagcagctagancctagaagtntttgcttagtttattactgtcagcagtcgtacggctaactccctcgtacggttcggcgggtaagggaccgaagggtcggagactacgaaacgtacgttgggaggctggaccaccgnttccgtnttcttcncttccgttccctcttgttaaccg

SEQ ID NO: 312584 - DNA, 495 bp, Homo sapiens
  misc_feature: GZ8MTXP01D3OR2.22.5.A05.1.454.CMB.2.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (406)..(407): a, c, t, g, unknown or other
  misc_feature (406)..(407): n is a, c, g, or t
  modified_base (410)..(410): a, c, t, g, unknown or other
  misc_feature (410)..(410): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
  modified_base (476)..(476): a, c, t, g, unknown or other
  misc_feature (476)..(476): n is a, c, g, or t
  modified_base (495)..(495): a, c, t, g, unknown or other
  misc_feature (495)..(495): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccaggggaaanagccaccctctcctgcagggccagtcagagtgttaactactacttagcctaggtaaccaacagaaacctggccaggctccaggctcncatctatgatgcatctacaggccatgcatcccagccaggttcagtgcagtggtccnggganagacttcaactctcacatcagcagtcctagagctagaagtattttgatagtttatangtanannagngacgacactcctcgtacgtcgcggaggacgagtagagananaacgacgngtgngtgcacgcttctntctctctcttcctcgcgtn

SEQ ID NO: 312585 - DNA, 614 bp, Homo sapiens
  misc_feature: GZ8MTXP01B9IOD.22.5.A05.1.454.CMB.2.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (570)..(570): a, c, t, g, unknown or other
  misc_feature (570)..(570): n is a, c, g, or t
tcagacatacgcgtcacgaccggtgctcgatttagatagatagacaggggggaggaactgctcagttaggacccagagggaaccatggaagccccagctcagcttctcttcctcctgctactctggctcccagaaaccaccggagaagttgtgttgacacagtctccagccaccctgtctttgtctccgaagggggaaanacgcccaccctctcctgcagggccagtcagtagtgttaactactacttagcctaggtaaccaacagaaacctggaccaggcctcccaggcctccncatctatgatgcatctacgngggccagtggcactccccagccctaggttcaggtggacgtaggtgggtccgtgggacagtacctttcaaaccttcctcaacctatcgaagcacgacctaagacgtcctagtaacgttattttgactttagttttattacgtgtcagtcagtcgttacggacctaacctccctacggtacggttccgggacggggtaggaaccgaagggtgaacgtactacgaaacgacgttggtacggctaggccttaaccgttnttacgttcgttccttcctccgttcccttacccgtcttaacgtcg

SEQ ID NO: 312586 - DNA, 568 bp, Homo sapiens
  misc_feature: GZ8MTXP01B1GPB.22.5.A05.1.454.CMB.2.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (389)..(389): a, c, t, g, unknown or other
  misc_feature (389)..(389): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgttctttgtctccgaggggaaanagccaccctctcctgcagggccagtcagagtgttaactactacttagcctggtaaccaacagaaacctggccaggctcccaggctccncatctatgatgcatctacnggccatgcatcccagccaggttcagtggcaggtgggtctgggacagtcttcaactctcacatcagcagcctagagctagaagtnttttgacttagtttattactgtacagcgagacgttaggacctaaccgtccctcgtaccggttcggacgggacgggaaccgaaggggttggaagtacgtaacgaaaaccggtagttcggtaggcgtacggccaccgttcttcgtcgttcttccgtacttccttcccgccttaacgttccg

SEQ ID NO: 312587 - DNA, 579 bp, Homo sapiens
  misc_feature: GZ8MTXP01DHI4C.22.5.A05.1.454.CMB.2.raw
  modified_base (192)..(192): a, c, t, g, unknown or other
  misc_feature (192)..(192): n is a, c, g, or t
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
  modified_base (406)..(406): a, c, t, g, unknown or other
  misc_feature (406)..(406): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtcttgtctcaggggaanagccaccctctcctgcagggccagtcagagtgttaactactacttagcctggtaccaacagaaacctggccaggctcccaggctcctcatctatgatgcatctacagggccatggcatcccagcccaggttcagtgcnggtggtctgggacngtacttcaactctcacatcagcagcctagagcctagaagtatttgtactaagtttattactntacagctagcgtacggacaaccttcccgtacgtacggttcggacgggtagggaaccgtaaggtaggagtacgtaacgaaaacggtacgttgggtaggctacggccttaaccgttcgttacgttcgttacctttccgtacctttcccgttaccccgtcccgttaacgttaaccg

SEQ ID NO: 312588 - DNA, 609 bp, Homo sapiens
  misc_feature: GZ8MTXP01DO6KF.22.5.A05.1.454.CMB.2.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
  modified_base (345)..(345): a, c, t, g, unknown or other
  misc_feature (345)..(345): n is a, c, g, or t
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgttcttgtctccgaggggaaanacgccaccctctcctgcaggccagtcagtagtgttaactactactagcctaggtaaccaacagaaacctggaccaggcctcccaggcctccncatctatgatgcatcttacgacgggccatggcactcccagcccgtaggtcaggtgcnggtcggtctgggacagtcttcaactctcacatcagcagcctagcgctagaagtntttgacttaagtttacttacgtgtnacgcagtcggtagacctaaccttccctacgtaaccgggttccgggacgggtaacggggaaccgtaaaggggtacggaagtaaccgtaacgaaaacggtaacttggggtacggttactacggcaaacccgttgtttaccttcgttccttccgtacttccccgttacccgtaacgttaacgtaaccg

SEQ ID NO: 312589 - DNA, 525 bp, Homo sapiens
  misc_feature: GZ8MTXP01BN1E1.22.5.A05.1.454.CMB.2.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaangccaccctctcctgcagggccagtcagagtgttaactactacttagcctggtaccaanagaaacctggccaggctcccaggctccncatctatgatgcatctangggccagtgcatcccagccaggttcagtggcaggtgggtctgggacagacttcaactcncaccatcancagcctagagcctagaagtatttgcttagttttatactgtcagcagcgtaggcaaccttccctacgtaccgttcggcggtaacggaccgaggtggagataccgaaagaacttggnggttcngcacnttctntcttnacttcttcccgcttaattcg

SEQ ID NO: 312590 - DNA, 718 bp, Homo sapiens
  misc_feature: GZ8MTXP01B0QJ7.22.5.A05.1.454.CMB.2.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
  modified_base (351)..(351): a, c, t, g, unknown or other
  misc_feature (351)..(351): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaangccaccctctcctgcagggccagtcagagtgttaactactacttagcctaggtaaccaacagaaacctggaccaggctcccaggctccncatctatgatgcatctacgaggccatcggacatcccagccctaggttcagtggcaggtcgggtcnggggacagtacttcaaaccttctaaccgaccataccacgccgaacgccctaaagacgaccttaggtaaacgttagttttagacgtttaagttttacttacttcgttacgacgacgtaacggtaccgggttaacgtacccgtaaacccgttccccgtacccgtaacccgggggtttccccggggaaccggggtaacgggggtaaaccccggtaaagggggttacgggaaacggtaacgttaaaccggaaaaaccgggtaacgttacggggtacggttacccgtacggaccgttaacccttacgttacccgttaacgttcccttaacctacccgttccctttacccccggtaacttaaccgtttaaccg

SEQ ID NO: 312591 - DNA, 553 bp, Homo sapiens
  misc_feature: GZ8MTXP01CISUS.22.5.A05.1.454.CMB.2.raw
  modified_base (198)..(198): a, c, t, g, unknown or other
  misc_feature (198)..(198): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
  modified_base (358)..(358): a, c, t, g, unknown or other
  misc_feature (358)..(358): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (417)..(417): a, c, t, g, unknown or other
  misc_feature (417)..(417): n is a, c, g, or t
  modified_base (519)..(519): a, c, t, g, unknown or other
  misc_feature (519)..(519): n is a, c, g, or t
  modified_base (532)..(532): a, c, t, g, unknown or other
  misc_feature (532)..(532): n is a, c, g, or t
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaagggggaaanagccaccctctcctgcagggccagtcagagtgttaactactacttagcctaggtaaccaacagaaacctggccaggctcccaggctccncatctatgatgcatcttanacgggccacgtggcatccccagccaggttcagtggcaggtggtcctgggacngacttcaactctcacatcagcaagcctaganctagaatntttgctagtttatctgtcancgagcgtaggacctaaccgtccctacgacggttccggacgggaacgggacctaaagggtgaagactaaacgaaacgtaacttggtacggcctagacaccttnttcgtaatcttcncttcttacccnccttntaacg

SEQ ID NO: 312592 - DNA, 589 bp, Homo sapiens
  misc_feature: GZ8MTXP01EYJD9.22.5.A05.1.454.CMB.2.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (287)..(287): a, c, t, g, unknown or other
  misc_feature (287)..(287): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
  modified_base (546)..(546): a, c, t, g, unknown or other
  misc_feature (546)..(546): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanacgccaccctctcctgcagggccagtcagagtgttaactactacttagcctggtaccaanagaaacctggccaggcctcccaggcctccncatctatgatgcatctacgagggccactggcactcccagcccaggttcagtggcaggtggtccnggggacagacttcaactctcacntcagcagcctagacgcctagtaagtatttgacttagtttattacgtgtacagctagtcgtacggactaacccttcccgtacgtacgggttccggacgggaacggggaaccgtaaggggtaggaagtaacgtaacgaaacggtaacgttgggtcggttactcggacaccgttnttcttcgttcttctacttcccttccccgtcttaacgttaaccg

SEQ ID NO: 312593 - DNA, 557 bp, Homo sapiens
  misc_feature: GZ8MTXP01BRVB0.22.5.A05.1.454.CMB.2.raw
  modified_base (195)..(195): a, c, t, g, unknown or other
  misc_feature (195)..(195): n is a, c, g, or t
  modified_base (279)..(279): a, c, t, g, unknown or other
  misc_feature (279)..(279): n is a, c, g, or t
  modified_base (476)..(476): a, c, t, g, unknown or other
  misc_feature (476)..(476): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgctccaggggaaangccaccctctcctgcagggccagtcagagtgttaactactacttagcctggtaaccaacagaacctggccaggctccaggctcncatctatgatgcatctacagggccatggcatcccagccaggttcagtgcaggtggtctagggacagacttcaactctcacatcagcaagtcctagacgtctagaagtatttgacttagttttattactgtacagcagtcgtaggactaacctccctacgtaccggttcgggacgggagggaccgaagggtcgggaanacgtaacgaaacgtacgttggtcggctacggcacgttattccgttgtcccttcacttcccgttcccgtaaccttcttaacg

SEQ ID NO: 312594 - DNA, 555 bp, Homo sapiens
  misc_feature: GZ8MTXP01AEIYL.22.5.A05.1.454.CMB.2.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (523)..(523): a, c, t, g, unknown or other
  misc_feature (523)..(523): n is a, c, g, or t
  modified_base (546)..(546): a, c, t, g, unknown or other
  misc_feature (546)..(546): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanagcccaccctctcctgcagggccagtcagagtgttaactactacttagcctaggtaaccaacagaaacctggccaggctccaggctcncatctatgatgcatcttacaggggccacgtggcactccccagcccaggttcagtggcaggtgggtcctggggacagacttcaactctcaccatccagcagaccctagacgtcctagaagtattttagcttaagtttattactgtacagtcagtacgtaggactaactccctacgtacggttcggcgggacgggaccgaagggtggaagagtacaaacggtagaggtggctggaccacncgttatcttctctactccttccncaacgttcg

SEQ ID NO: 312595 - DNA, 629 bp, Homo sapiens
  misc_feature: GZ8MTXP01BE1KT.22.5.A05.1.454.CMB.2.raw
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (417)..(417): a, c, t, g, unknown or other
  misc_feature (417)..(417): n is a, c, g, or t
  modified_base (617)..(617): a, c, t, g, unknown or other
  misc_feature (617)..(617): n is a, c, g, or t
tcagacatacgcgtcacgaccggtgctcgatttagatagatagacaggggggaggaactgctcagttaggacccagagggaaccatggaagccccagctcagcttctcttcctcctgctactctggcctcccagaaaccaccggagaagttgtgttgacacagtctccagccaccctgtctttgtctccgaggggaaancgcccaccctctcctgcagggccagtcagagtgttaactntacttagcctaggtaccaanagaacctggccaggctcccgaggctccncatctatgatgctatctacagggccagtcggcactccccgaagcccgtaggtttccaggttcggacaggttcgggggtcctggggactaggtaccttccaacttcctcacctatcacgtcagcctagacncctagtaagtatttgacttaagttttattactgttacagtactagtaccgtagaccctaaaccgttcccctacggtaccgggttaccggcggggtaacgggtacccggtaaagggtcgggtaagaacgtaacgaaacggtaacgttgggtcgccgtagcccaaccttgttccttcgttcttcctaccttccgttaccccncttaacgttccg

SEQ ID NO: 312596 - DNA, 569 bp, Homo sapiens
  misc_feature: GZ8MTXP01A4CUR.22.5.A05.1.454.CMB.2.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (395)..(395): a, c, t, g, unknown or other
  misc_feature (395)..(395): n is a, c, g, or t
  modified_base (483)..(483): a, c, t, g, unknown or other
  misc_feature (483)..(483): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccgaggggaaangccaccctctcctgcagggccagtcagagtgttaactactacttagcctggtaaccaanagaacctggccaggctccaggctcncatctatgatgctatcttacgagggccagtggcactcccagcccaggttcagtggctaggtgggtcctgggacagtacttcaactctcacatcagcacgctagacgctagaagtntttgacttagtttattactgtcagcagtcgtacggactaaccgtccctcgtacggttcgggacgggaacgggaccgaagggtgggaanacgtaaacgaaacggtcgttggtcggctacggccaccgttcttcgttaacgttccttctacttcccttacccgtcttaacgttccg

SEQ ID NO: 312597 - DNA, 552 bp, Homo sapiens
  misc_feature: GZ8MTXP01EOSEY.22.5.A05.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (227)..(227): a, c, t, g, unknown or other
  misc_feature (227)..(227): n is a, c, g, or t
  modified_base (330)..(330): a, c, t, g, unknown or other
  misc_feature (330)..(330): n is a, c, g, or t
  modified_base (338)..(338): a, c, t, g, unknown or other
  misc_feature (338)..(338): n is a, c, g, or t
  modified_base (375)..(375): a, c, t, g, unknown or other
  misc_feature (375)..(375): n is a, c, g, or t
  modified_base (515)..(515): a, c, t, g, unknown or other
  misc_feature (515)..(515): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccgaggggaaangccaccctntcctgcagggccagtcagagtnttaactactacttagcctggtaaccaacagaacctggccaggctccaggctcctcatctatgatgcatctacagggccatgcatcccagccaggttcagtgcnggtggtcngggacagacttcaactctcacatcagcagcctagacnctagtagtatttgacttagtttattactgtactagcagtcgtacggactaaccgttcccgtacgtaccggttcgggacggacgggaaccgagggtaggaagtacgtacgaaacgtaacgttggtacggctcgcaccgttnttcgtgttcttctactccttcccgtccttgttaaccg

SEQ ID NO: 312598 - DNA, 619 bp, Homo sapiens
  misc_feature: GZ8MTXP01DJHPI.22.5.A05.1.454.CMB.2.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaagggggaaanacgccaccctctcctgcagggccagtcagagtgttaactactacttagcctggtaccaacagaaactggccaggctccagctcnatctatgatgcatctacgngggccatcggcatcccagccaggttcaggtggctaggtcggtcgngggtacagtactcaactctcaccatcacgcagcctagacgctagaatatttgacttagtttacttacgtgtacagacgagtaccgtaggactaaccttccccgtacgtaaccggttccgggacggggacgggtaaacccggtaaagggtcgggaaacgtaacgtaacccgaaaaacggtaaccgttgggtaccggacttcggaaccccttacgttaacttccggttaacttcccttaacgtacccttcccttccccgtcccttaagttcccg

SEQ ID NO: 312599 - DNA, 624 bp, Homo sapiens
  misc_feature: GZ8MTXP01BG7B9.22.5.A05.1.454.CMB.2.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaangccaccctctcctgcagggccagtcagagtgttaactactacttagcctaggtaaccaacagaaacctggccaggctcccaggcctccncatctatgatgctatctacgngggccacgtggcactccccagccctaggttcaggtcggcaggtgggtccnggggacagtacttcaacttctcacctatcgagccagcctaagacgtccgtagtaagttgttttcgacttaagttttacttacgtcgtacgagtccgagtaccgttacggacctaaccgttcccgtacgtaccgggttcgggaccgggtaacgggtaaccgaggggtacggaacgtacgtaaccgaaaacggtacgttgggtcggttcgtacgccttacttcgttccgtcgttccttctacgttcccttacccgtccgttaacgtccg

SEQ ID NO: 312600 - DNA, 546 bp, Homo sapiens
  misc_feature: GZ8MTXP01EKVHG.22.5.A05.1.454.CMB.2.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
  modified_base (285)..(285): a, c, t, g, unknown or other
  misc_feature (285)..(285): n is a, c, g, or t
  modified_base (511)..(511): a, c, t, g, unknown or other
  misc_feature (511)..(511): n is a, c, g, or t
tcagacatacgcgtcacgaccggtgctcgatttagatagatagacaggggggaggaactgctcagttaggacccagagggaaccatggaagccccagctcagcttctcttcctcctgctactctggctccccagaaaccaccggagaagttgtgttgacacagtctccagccaccctgtctttgtctccaggggaaangccaccctctcctgcaggggccagtcagagtgttaactactacttagcctggtaccaanagaaacctggccaggctcccaggctccncatctatgatgcatcttacagggccactggcatccccagcccaggttcagtggcaggtgggtcctggggacagacttcaacttctcaccatcagcagcctagacgcctagaagtattttgcttagttttattactgtcagcagcgtaggctaaccttccctcgacggttcggcggacgggaccgaagggtggagactacgaaacgtacgttggtggctgcaccttnttctgttccttcacttccttcccgtccttgttccg

SEQ ID NO: 312601 - DNA, 592 bp, Homo sapiens
  misc_feature: GZ8MTXP01B3EOX.22.5.A05.1.454.CMB.2.raw
  modified_base (193)..(193): a, c, t, g, unknown or other
  misc_feature (193)..(193): n is a, c, g, or t
  modified_base (252)..(252): a, c, t, g, unknown or other
  misc_feature (252)..(252): n is a, c, g, or t
  modified_base (307)..(307): a, c, t, g, unknown or other
  misc_feature (307)..(307): n is a, c, g, or t
  modified_base (411)..(411): a, c, t, g, unknown or other
  misc_feature (411)..(411): n is a, c, g, or t
tcagacatacgcgtcacgaccggtgctcgatttagatagatagacagggggaggaactgctcagttaggacccagagggaaccatggaagcccagctcagcttctcttcctcctgctactctggctcccagaaaccaccggagaagttgtgttgacacagtctccagccacctgtctttgctccgaggggaangccacctctctgcagggccagtcagagttgttaactactacttagcctaggtaaccaanacgaaacctggaccaggcctcccgaggcctcctcatctatgatcgctatctacgnggccatcggcactccagccgtaggttcaggtggctagggtggtcgtggggactaggaccttcaactctcactatcgagcagccgtagacgtcctaggtaagttntttggacttagtttattactgtacagcagcgtacggctaaccgttccgtacgtacggttcgggcggtagggtaccgtagggtcgaagtacgtaacgaaacgtagttggtacggcgtacgcttacttacgttcgttaacgtccttcgtaccttccgttaccccgtaacttaacgttaacccg

SEQ ID NO: 312602 - DNA, 707 bp, Homo sapiens
  misc_feature: GZ8MTXP01B4SED.22.5.A05.1.454.CMB.2.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
  modified_base (390)..(390): a, c, t, g, unknown or other
  misc_feature (390)..(390): n is a, c, g, or t
tcagacatacgcgtcacgaccggtgctcgatttagatagatagacagggggaggaactgctcagttaggacccagagggaaccatggaagccccagctcagcttctcttcctcctgctactctggcctcccagaaaccaccggagaagttgtgttgacacagtctccagcccaccctgtctttgtctccgaaggggaaancgcccaccctctcctgcagggccagtcagtagttagttaactacttacttagcctaggtaacccaacagaaacctggccaggcctccaggctcncatctatgatgcattctacgagggccatggcactcccagcctaggttcagttcggctaggttggtccgtggggactagtccttcaacttcctcacntccgagccaggccctaagctacgtagtaagtagttttagacgtttaagttttacttactcgggttacagtcgtaaggtaccgtaaggggtacccttaaaccccgttccccgttacggtacccgggtttaccggggaccggggaacggggtaaacccggtaagggttacgggggaaaccgtaacggtaaacccggtaaaaaaccggttaccggttgggttacgggttaccgtacgggtacccttaaaccgttctttccggtttcttacccgtttaaccttaccggttcccctttaccccggaaccttcgttaacccgg

SEQ ID NO: 312603 - DNA, 651 bp, Homo sapiens
  misc_feature: GZ8MTXP01E0Y8U.22.5.A05.1.454.CMB.2.raw
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaancgccacctctcctgcagggccagtcagagttgttaactactacttagcctaggtaaccaanagaaacctggaccaggcctcccgaggcctccncatctatgatgctatctanagggccacgtgcatcccagccaggttcagtgcaggtggtctgggacagtacttcgaaactctcaccatcgaacgcacgcctagacgcctagaagttattttagcttaagtttattacgtagtacgagtcgaagtcggtaacggtaccgtaaacccgttcccgtaccgtaacccgggtttcgggacccggggtaaacggggaacccggtaaggggttacgggaaagtaacgtaaaccgaaaacggtaacgttgggtaccgggttctaccggtaccaacccgttgttcccgttaacgttccctttaacgtaccttccccgttacccgaaccttaacgtttcccg

SEQ ID NO: 312604 - DNA, 539 bp, Homo sapiens
  misc_feature: GZ8MTXP01DN835.22.5.A05.1.454.CMB.2.raw
  modified_base (196)..(196): a, c, t, g, unknown or other
  misc_feature (196)..(196): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
tcagacatacgcgtcacgaccggtgctcgatttagatagatagacaggggggaggaactgctcagttaggacccagagggaaccatggaagccccagctcagcttctcttcctcctgctactctggctcccagaaaccaccggagaagttgtgttgacacagtctccagccacctgtctttgtctcaaggggaaangccaccctctcctgcagggccagtcagagtgttaaactactacttagcctaggtaaccaaanagaaacctggccaggctccaggctcncatcatgatncatctanagggccatgacatcccagccaggttcagtgacagtgggtctgggacagacttcaactctcacatcagcagctananctgaatatttgntaagtttattactgtacanacacgacgtacggactaacctaccctaccgtacggtacggacgggaacggaacggaaggtaggaagaacgaacgaaacgaacgttagtgcgtacgacacncttctntctctactcttacctccgttcgtcg

SEQ ID NO: 312605 - DNA, 607 bp, Homo sapiens
  misc_feature: GZ8MTXP01ANKJY.22.5.A05.1.454.CMB.2.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
  modified_base (379)..(379): a, c, t, g, unknown or other
  misc_feature (379)..(379): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaangccaccctctcctgcagggccagtcagagtgttaactactacttagcctggtaaccaacagaaacctggaccaggcctcccgaggctccnatctatgatgcatctacnggccatgcactcccagccaggttcaggttggcaggtgggtccgtgggacagtacttcaactctcactatcacgnacgcctagacgctagaacgttatttgacttaagtttattacgtcgtacagacgtagtccgtacgggtacctaacccgtcccgtacgtaccggttccgggacgggtaacggggaccggtaaggggtaggtaacggaacgtacgaaaacggtacggttaggtcgggcttacggaccaccgttgttccttaacgttcttctacgttcccttaccgtccttaacgttcccgg

SEQ ID NO: 312606 - DNA, 676 bp, Homo sapiens
  misc_feature: GZ8MTXP01BT69R.22.5.A05.1.454.CMB.2.raw
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (645)..(645): a, c, t, g, unknown or other
  misc_feature (645)..(645): n is a, c, g, or t
tcagacatacgcgtcacgaccggtgctcgatttagatagatagacaggggggaggaactgctcagttaggacccagagggaaccatggaagccccagctcagcttctcttcctcctgctactctggctcccagaaaccaccggagaagttgtgttgacacagtctccagccaccctgttctttgtctccgaggggaaagacgcccaccctctcctgcagggccagtcagagtgttaactactacttagcctggtaaccaacagaaacctggccaggcctcccgaggctccncatctatgatgcattctacgngggccagtcggacactccccagcccgtaggttcgaggttcggcgtagggttcggggtcctagggggactacggacctttccaaaccgttcctccaccctatacccacgcgtacgccctaaggaccgtacgtacgtaaaggtatttttgacgtttaacggtttttaattaccgttgttaccaggtcgtaaggtaccgttaacgaccgttaaaccccgttcccgttacgtaaccgggtttcccggggacggggaaccggggtaaccgtaaggggttacgggaacgtacgtaaccggaaaacgtagttcgggtacgcgtacgcaccttgttcgttnttactctaccgttccttcccgtcttcgttcg

SEQ ID NO: 312607 - DNA, 577 bp, Homo sapiens
  misc_feature: GZ8MTXP01DKAX2.22.5.A05.1.454.CMB.2.raw
  modified_base (199)..(199): a, c, t, g, unknown or other
  misc_feature (199)..(199): n is a, c, g, or t
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (405)..(405): a, c, t, g, unknown or other
  misc_feature (405)..(405): n is a, c, g, or t
tcagacatacgcgtcacgaccggtgctcgatttagatagatagacaggggggaggaactgctcagttaggacccagagggaaccatggaagccccagctcagcttctcttcctcctgctactctggctcccagaaaccaccggagaagttgtgttgacacagtctccagccaccctgtctttgtctccgagggggaaangcccaccctctcctgcagggccagtcagagtgttaactactacttagcctaggtaccaaanagaaacctggccaggcctcccaggcctcncatctatgatgcatctacngggccatgcatcccagccaggttcaggtggcaggtgggtcctggggacagtacttcaaacttctcaccatcagccagcctaagacgctaggaacgtnttttgactagttttaattactgtacagcctagcgtagtcctaacttccctacgacgttcgggacgggacggaaccgtaaggtggaagactaacgaaaacgtacgttggtcggcgtacggccttacttacgttcttcgttacttctacgttcccttcccgtccttaagttccg

SEQ ID NO: 312608 - DNA, 613 bp, Homo sapiens
  misc_feature: GZ8MTXP01AYU3Q.22.5.A05.1.454.CMB.2.raw
  modified_base (288)..(288): a, c, t, g, unknown or other
  misc_feature (288)..(288): n is a, c, g, or t
tcagacatacgcgtcacgaccggtgctcgatttagatagatagacaggggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaagagcccaccctctcctgcagggccagtcagagttgttaactactacttagcctaggtaccaacagaaacctggccaggcctccaggctccncatctatgatgcatctacgagggccagtcggcactccccagccctaggttcaggtgcgaggtgggtccctggggacagtactcaacttctcaccatcgagcagcctaagactcctaggtaacgtattttgacttaagtttacttacgtgtcagtcagtacgaggcctaacctcccgtacgtacggttcggggacgggacgggtaaccgaagggtcggaacgtaacgaaccgtaaaacggtacgttgggtacggcgttacggacccacgttacgttcttaacggttccttcctacttccccgttaccccgtccttaacttaaccgg

SEQ ID NO: 312609 - DNA, 521 bp, Homo sapiens
  misc_feature: GZ8MTXP02JHKFJ.22.5.A05.1.454.CMB.2.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggctcccaggctcctcatctatgatgcatctacngggccatggcatcccagccaggttcagtggcaggtggtcctgggacagacttcactctcaccatcagcagcctagacgcctagaagtattttgctagtttattactgtcagcagcgtagcaactcctacacgttcggcggtacggaccgaggtcggagatacgaaacggaactggtcggactgccaaccatctgtcttacacttcctcccgtctactcg

SEQ ID NO: 312610 - DNA, 558 bp, Homo sapiens
  misc_feature: GZ8MTXP02I0H7L.22.5.A05.1.454.CMB.2.raw
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccaggggaaangccaccctctcctgcagggccagtcagagtgttaactactacttagcctggtaccaanagaacctggccaggctcccaggctcctcatctatgatgcatcttacagggccagtggcatcccagcccaggttcagtgcagtggtcctgggacagacttcacttcncaccntcagcagcctaganctgaagtntttgctagtttatactgtacagcagctacgctaacctccctacgtacggttccggcgggaacgggacccgaaaggggttcggaaagtacgtacgaaaacgtaacgttggtacgggactcggactaaccgtacttcgtcgttctttacacttccctcccggtcctaacttccg

SEQ ID NO: 312611 - DNA, 505 bp, Homo sapiens
  misc_feature: GZ8MTXP02GXTDV.22.5.A05.1.454.CMB.2.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (424)..(424): a, c, t, g, unknown or other
  misc_feature (424)..(424): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaanagaaacctggccaggctcccagctcctcatctatgatgcatctacagggccatggcatcccagccaggttcagtggcagtggcctggggacagacttcactctcaccatcagcagcctagagcctgaagatttgctagtttattactgtcagcagcgtagcaactcccnctacgttcggcggagggaccaaagggtggagatacgaaaacgaactggtaggctgcaccatctgtcttcatctcccgcatc

SEQ ID NO: 312612 - DNA, 539 bp, Homo sapiens
  misc_feature: GZ8MTXP02JF1Z5.22.5.A05.1.454.CMB.2.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (393)..(393): a, c, t, g, unknown or other
  misc_feature (393)..(393): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaanagaaacctggccaggctcccaggctcctcatctatgatgcatcttacagggccactggcatcccagcctaggttcagtgcaggtgggtcctggggacagacttcactctcaccatcagcagcctagacgctagaagtnttttgacttagtttattacgtgtacagcagcgtagcctaactccctacgacgttcggacggtacgggaccgaagggtcggagagtacaaaacgtacgtggtacgctacgcaaccagtctgtcttacacttcctacccgtcacttcg

SEQ ID NO: 312613 - DNA, 524 bp, Homo sapiens
  misc_feature: GZ8MTXP02GT5DC.22.5.A05.1.454.CMB.2.raw
  modified_base (196)..(196): a, c, t, g, unknown or other
  misc_feature (196)..(196): n is a, c, g, or t
  modified_base (517)..(517): a, c, t, g, unknown or other
  misc_feature (517)..(517): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggcctcccaggctcctcatctatgatgcatctacagggccactggcatcccagccaggttcagtggcaggtggcctggggacagacttcactctcaccatcagcagcctagacgcctagaagtattttgctagtttattactgtcagcagcgtagcaactccctcgacgttggaccggagggaccaagggtcggaagagtacgaaaacgacgtgtacggctcggcacatctgtctctatccgttacccnctactcg

SEQ ID NO: 312614 - DNA, 538 bp, Homo sapiens
  misc_feature: GZ8MTXP02JX1XJ.22.5.A05.1.454.CMB.2.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccaccctctcctgcagggccagtcagagtgttaactactacttagcctggtaccaacagaaacctggccaggctcccaggctcctcatctatgatgcatctacngggccatggcatcccagccaggttcagtggcaggtgggtcctggggacagacttcactctcaccatcagcagcctagagcctagaagtatttgctagtttattacgtgtcagcagcgtagcaactccctcgacgttcggacggacgggaccgaagggtcggagacgtacgaaaacggactaggtcggactcgaccacctatcctgttccttacacttcctcccgacctacgttaccg

SEQ ID NO: 312615 - DNA, 555 bp, Homo sapiens
  misc_feature: GZ8MTXP02H24CS.22.5.A05.1.454.CMB.2.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (289)..(289): a, c, t, g, unknown or other
  misc_feature (289)..(289): n is a, c, g, or t
  modified_base (380)..(380): a, c, t, g, unknown or other
  misc_feature (380)..(380): n is a, c, g, or t
  modified_base (447)..(447): a, c, t, g, unknown or other
  misc_feature (447)..(447): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccacctctcctgcagggccagtcagagtgttaactactacttagcctggtaccaanagaaacctggccaggctcccaggctcctcatctangatgcatcttacagggccatggcatcccagccaggttcagtgcagtggtcctggggacagcttcacttctcaccattagcagccctagacncctagaagtattttgactagttttattactgtcagtcagtcgtagccaactccctcacggtttcggngggacggacgaaggtggaagatacgaaaacgtacgtggtacggctaggaccaccgtattcgtggttaacctttccaactttccttccccggacctactaccgtaacgg

SEQ ID NO: 312616 - DNA, 520 bp, Homo sapiens
  misc_feature: GZ8MTXP02GRNZH.22.5.A05.1.454.CMB.2.raw
  modified_base (195)..(195): a, c, t, g, unknown or other
  misc_feature (195)..(195): n is a, c, g, or t
  modified_base (513)..(513): a, c, t, g, unknown or other
  misc_feature (513)..(513): n is a, c, g, or t
tcagacatacgcgtcacgaccggtgctcgatttagatagatagacagggggaggaactgctcagttaggacccagagggaaccatggaagccccagctcagcttctcttcctcctgctactctggctccagaaaccaccggagaagttgtgttgacacagtctccagccaccctgtctttgtctccaggggaaangccacctctcctgcagggccagtcagagtgttaactactacttagcctggtaccaacagaaacctggccaggctcccaggctcctcatctatgatgcatcttacagggccatggcatcccagccaggttcagtggcaggtggtcctgggacagacttcactctcaccatcagcagcctagagctgaagtatttgctagtttatactgtcagcagctagctaactccctacgtacgttcgggacggacgggaccaaggggtcggaagatacgaaaacgactggtacggctagacacctatctgtctacactccttcccnctactcg

SEQ ID NO: 312617 - DNA, 527 bp, Homo sapiens
  misc_feature: GZ8MTXP02JSU86.22.5.A05.1.454.CMB.2.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaanagaacctggccaggctcccaggctcctcatctatgatgcatcttacagggccactggcatccagccaggttcagtgcaggtggtctgggacagacttcactctcacntcagcagcctagncctgaatatttgctagtttatactgtcagcagcgtagctaactccctactacggttcggacggacgggaccgaagggtggagactacgaaaacgtacgtggtacgctcggaccacctatcgtgttccttacacttcccttcccgctacttcg

SEQ ID NO: 312618 - DNA, 518 bp, Homo sapiens
  misc_feature: GZ8MTXP02JD0PY.22.5.A05.1.454.CMB.2.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccacctctcctgcagggccagtcagagtgttaactactacttagcctggtaccaanagaaacctggccaggctcccaggctcctcatctatgatgcatcttacngggccatggcatcccagcccaggttcagtggcaggtggtcctgggacagacttcactctcaccatcagcagcctagagcctagagatttgctagtttatactgtcagcagcgtagctaactccctacgacgttcggacggacgggaccaagggtggagatacgaaaacgactggtacggctcggcaccatctgtcttcactcttcccgacctatccg

SEQ ID NO: 312619 - DNA, 560 bp, Homo sapiens
  misc_feature: GZ8MTXP02IOCG0.22.5.A05.1.454.CMB.2.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctccaggggaaanagccaccctctcctgcagggccagtcagagtgttaactactacttagcctggtacccaacagaaacctggccaggctccaggctcctnatctatgatgcatcttacngggccatggcatcccagcccaggttcagtggcaggtggtcctggggacagacttcactctcaccatcagcagcctagacgcctagaatattttgctagttttacttactgttacagcagtcgtagcctaacctccctagtaccggttccgggacggacgggaccaaagggtggaagtactacgaaaacgtacgtggcggactcggaccaaccgtattccgtgttccttactacttcccgtttccccgactaacttccg

SEQ ID NO: 312620 - DNA, 513 bp, Homo sapiens
  misc_feature: GZ8MTXP02JZNE5.22.5.A05.1.454.CMB.2.raw
  modified_base (196)..(196): a, c, t, g, unknown or other
  misc_feature (196)..(196): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccaccctctcctgcagggccagtcagagtgttaactactacttagcctggtaccaacagaaacctggccaggctcccaggctcctcatctatgatgcatctacagggccatggcatcccagccaggttcagtgcaggtggtctgggacagacttcactctcaccatcagcaagcctagcgctagaagtatttgactagttatactgtcagcagctagctactcctacgtacgttcggacggtaggacgaaggtggagatacgaaacgacgtggcggactcgcacctatctgtcttcacttccttcccgctactccg

SEQ ID NO: 312621 - DNA, 527 bp, Homo sapiens
  misc_feature: GZ8MTXP02GFMNF.22.5.A05.1.454.CMB.2.raw
  modified_base (196)..(196): a, c, t, g, unknown or other
  misc_feature (196)..(196): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggctcccaggctcctcatctatgatgcatcttacagggccatggcatcccagcccaggttcagtggcagtggtctgggacagacttcactctcaccatcagcagcctagagcctagaagattttgctagtttatactgtcagcagctagcaactccctacgacgttcggcggagggaccaaagggtggaacgatacgaaaacgaacgtggtcggactggaccaccgactctgttcttactactcctccgacctactacg

SEQ ID NO: 312622 - DNA, 515 bp, Homo sapiens
  misc_feature: GZ8MTXP02FZSGX.22.5.A05.1.454.CMB.2.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
  modified_base (486)..(486): a, c, t, g, unknown or other
  misc_feature (486)..(486): n is a, c, g, or t
tcagacatacgcgtcacgaccggtgctcgatttagatagatagacaggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccacctctcctgcagggccagtcagagtgttaactactacttagcctggtaccaanagaaacctggccaggctcccaggctcctcatctatgatgcatcttacagggccatggcatcccagccaggttcagtggcagtggtcctgggacagacttnactctcaccatcagcagcctagngcctgaagtatttgctagttattactgtcagcagcgtagcaactcctcacgttcggcggtagggaccgaaggtggaagagtacaaaacgaactggtaggctcggcaacctntctgtcttactacttcctcccgctactcg

SEQ ID NO: 312623 - DNA, 521 bp, Homo sapiens
  misc_feature: GZ8MTXP02ILDH7.22.5.A05.1.454.CMB.2.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
  modified_base (389)..(389): a, c, t, g, unknown or other
  misc_feature (389)..(389): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctcaggggaaangccacctctcctgcagggccagtcagagtgttaactactacttagcctggtaccaanagaaacctggccaggctcccaggctcctcatctatgatgcatcttacagggccatggcatcccagcccaggttcagtggcaggtgggtcctggggacagtacttcactctcaccatcagcagcctagacgctgaagtnttttgctagtttattactgtacagcagcgtagacacctccctcgacgttcggacggaggacaagggtgagatacgaaaacgtacgtgtacggctcgcacctatctgtctactctccttacccgctattaccg

SEQ ID NO: 312624 - DNA, 504 bp, Homo sapiens
  misc_feature: GZ8MTXP02HUNQS.22.5.A05.1.454.CMB.2.raw
  modified_base (196)..(196): a, c, t, g, unknown or other
  misc_feature (196)..(196): n is a, c, g, or t
  modified_base (353)..(353): a, c, t, g, unknown or other
  misc_feature (353)..(353): n is a, c, g, or t
  modified_base (416)..(416): a, c, t, g, unknown or other
  misc_feature (416)..(416): n is a, c, g, or t
  modified_base (446)..(446): a, c, t, g, unknown or other
  misc_feature (446)..(446): n is a, c, g, or t
  modified_base (477)..(477): a, c, t, g, unknown or other
  misc_feature (477)..(477): n is a, c, g, or t
  modified_base (497)..(497): a, c, t, g, unknown or other
  misc_feature (497)..(497): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccacctctcctgcagggccagtcagagtgttaactactacttagcctggtaccaacagaaacctggccaggctcccaggctcctcatctatgatgcatcttacagggccatggcatcccagccaggttcagtgcagtggcctggggacagacttnactctcaccatcagcagcctagacgctgaagtatttgctagttttatactgtcagcagcgtanctactccacgacgtcggcggaggacgaggngagactacgaaaacgagtgcgctagacactntctgtcttcacttcctaccnctactcg

SEQ ID NO: 312625 - DNA, 553 bp, Homo sapiens
  misc_feature: GZ8MTXP02I3WIB.22.5.A05.1.454.CMB.2.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccaccctctcctgcagggccagtcagagtgttaactactacttagcctggtacccaanagaaacctggccaggctcccaggctctcatctatgatgcatcttacagggccacgtggcactcccagcccaggttcagtgcaggtggtctgggacagacttcactctcacatcagcagcctagacgctagaagtatttgacttagtttattactgtacagcaggtcgtagcctaacctcccctagtaccggttcgggacgggacgggaccgaagggtggaagtacgtacgaaaacgacgtggtcggctacgacctacctagttctcgttcttactacttcccttcccgcctacgttcg

SEQ ID NO: 312626 - DNA, 501 bp, Homo sapiens
  misc_feature: GZ8MTXP02HGW4W.22.5.A05.1.454.CMB.2.raw
  modified_base (194)..(194): a, c, t, g, unknown or other
  misc_feature (194)..(194): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtcttgtctccaggggaaanagccacctctcctgcagggccagtcagagtgttaactactacttagcctggtaccaacagaaacctggccaggctcccaggctcctcatctatgatgcatctacagggccatggcatcccagccagttcagtgcagtggtcctgggacagacttcactctcaccatcagcagcctagagcctagaagtatttgctagtttattactgtcagcagcgtagctaactcctcacgttcggcggagggaccaaggtgagatacaaaacgactgtcgctgcaccatctgtcttacactcctccacctatccg

SEQ ID NO: 312627 - DNA, 529 bp, Homo sapiens
  misc_feature: GZ8MTXP02F9MJN.22.5.A05.1.454.CMB.2.raw
  modified_base (197)..(197): a, c, t, g, unknown or other
  misc_feature (197)..(197): n is a, c, g, or t
  modified_base (366)..(366): a, c, t, g, unknown or other
  misc_feature (366)..(366): n is a, c, g, or t
  modified_base (501)..(501): a, c, t, g, unknown or other
  misc_feature (501)..(501): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanagccaccctctcctgcagggccagtcagagtgttaactactacttagcctggtaccaacagaaacctggccaggctcccaggctcctcatctatgatgcatcttacagggccactggcatccccagcccaggttcagtgcaggtgggtcctgggacagtacttcactcncaccatcagcagcctagagcctagaagtatttgctagtttattactgtcagtcagcgtagacaactccctacgtacgttcggcggaggaccgaagggtgagactacgaaacgacgtgtacggctcgaccaacctntcgtgtctctacttcctccgactactcg

SEQ ID NO: 312628 - DNA, 532 bp, Homo sapiens
  misc_feature: GZ8MTXP02HUHX7.22.5.A05.1.454.CMB.2.raw
  modified_base (192)..(192): a, c, t, g, unknown or other
  misc_feature (192)..(192): n is a, c, g, or t
  modified_base (250)..(250): a, c, t, g, unknown or other
  misc_feature (250)..(250): n is a, c, g, or t
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtcttgtctcaggggaanagccacctctcctgcagggccagtcagagtgttaactactacttagcctggtaccaanagaaacctggccaggctcccaggctcctcatctatgatgcatcttacagggccactggcatcccagccaggttcagtgcaggtggtctgggacngacttcactctcacatcagcagcctagacnctagaatatttgcttagtttacttactgtacagtcagcgttagctaacctccctataccggttcggacgggacgggaccgaagggtcggagatacgaaaacgtacgtggtacggctacggccacgatcgttgtcttcactccgtttacccgctactcg

SEQ ID NO: 312629 - DNA, 535 bp, Homo sapiens
  misc_feature: GZ8MTXP02GT4R1.22.5.A05.1.454.CMB.2.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggctcccaggctcctcatctatgatgcatctacngggccatggcatcccagccaggttcagtggcaggtggtcctgggacagacttcactctcaccatcagcagcctagacgcctagaagtattttgcttagtttattactgtcagcagcgtagctaactccctactacggttcggacgggtacgggaccgaagggtggaagactacgaaaacgacgtggtacggctacgacaccatctcgttctactactccttacccgctactcg

SEQ ID NO: 312630 - DNA, 594 bp, Homo sapiens
  misc_feature: GZ8MTXP02GL80Y.22.5.A05.1.454.CMB.2.raw
  modified_base (196)..(196): a, c, t, g, unknown or other
  misc_feature (196)..(196): n is a, c, g, or t
  modified_base (548)..(548): a, c, t, g, unknown or other
  misc_feature (548)..(548): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggcctcccaggcctcctcatctatgatgcatcttacagggccatggcactcccagcccaggttcaggtgcaggtgggtccgtgggacagtacttcactctccaccatcgagcagccctagacgcctagaagttagttttgcgttagtttacttacgtggtacagtcaggtcgtagcctaacctcccgtacgaccggtttccgggacgggtaacggggaccgtaaggggtcggaagtaacgtaacgaaacggtaacgttggtacgggctcggaccaccgtnttaccgttcgttcttactaccttcccgtacccctactacgtttccg

SEQ ID NO: 312631 - DNA, 638 bp, Homo sapiens
  misc_feature: GZ8MTXP02JTMP3.22.5.A05.1.454.CMB.2.raw
  modified_base (142)..(142): a, c, t, g, unknown or other
  misc_feature (142)..(142): n is a, c, g, or t
  modified_base (193)..(193): a, c, t, g, unknown or other
  misc_feature (193)..(193): n is a, c, g, or t
  modified_base (251)..(251): a, c, t, g, unknown or other
  misc_feature (251)..(251): n is a, c, g, or t
  modified_base (281)..(281): a, c, t, g, unknown or other
  misc_feature (281)..(281): n is a, c, g, or t
  modified_base (392)..(392): a, c, t, g, unknown or other
  misc_feature (392)..(392): n is a, c, g, or t
tcagacatacgcgtcacgaccggtgctcgatttagatagatagacagggggaggaactgctcagttaggacccagagggaaccatggaagccccagctcagcttctcttcctcctgctactctggctccagaaaccaccggngaagttgtgttgacacagtctccagccaccctgtctttgtctcgagggaanagccacctctcctgcagggccagtcagagtgttaactactacttagcctggtaccaanagaaacctggccaggcctcccgagctcctnactctatgatgactattccgtaacgacgggccctagtcggacacctcccgacgtccgtaggtcaggtcggacgtagggtcggggtccgtacggggactacggtaccttacnccttccaccaccttcacgcgacacgtaccgtagaccgtcgttaagatttagttcgacgttatttactacgtctacgacgtacgacgttacggacaccgaccgtttcccgacggtttaccgggtcgacggggtaaccggaacggtagggtacgaagtacgtaaacgtaaacggtagtggaaccgttcgacgtaccaacgttcttcggtaactttcgtctaccgttccccttcccgactcgaaaccgg

SEQ ID NO: 312632 - DNA, 500 bp, Homo sapiens
  misc_feature: GZ8MTXP02JANMU.22.5.A05.1.454.CMB.2.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (425)..(425): a, c, t, g, unknown or other
  misc_feature (425)..(425): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaanagaaacctggccaggctcccaggctcctcatctatgatgcatcttacagggccatggcatcccagccaggttcagtgcagtggtctgggacagacttcactctcaccatcagcagcctagacgctgaagtatttgctagtttattactgtcagcagctagcaactccctnacgttcggcggaggacaggtggagagtcaaacgactgcggctcgcaccatctgtctcacttcctccgactctacg

SEQ ID NO: 312633 - DNA, 561 bp, Homo sapiens
  misc_feature: GZ8MTXP02J1S41.22.5.A05.1.454.CMB.2.raw
  modified_base (196)..(196): a, c, t, g, unknown or other
  misc_feature (196)..(196): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggctcccaggctcctcatctatgatgcatctacagggccactggcatcccagccaggttcagtgcagtggtcctgggacagacttcactctcaccatcagcagcctagacgcctagaagtatttgctagtttatacgtgtactagcagcgtagcctaactccctacgtaacggttccggacgggtacgggaacccgaaggggtacggaacgaacgtacaaaacggaaccgttaggacggctacggaccacctaatccgtgttccttcacttcccttccccgactacgttaccg

SEQ ID NO: 312634 - DNA, 514 bp, Homo sapiens
  misc_feature: GZ8MTXP02F2RIC.22.5.A05.1.454.CMB.2.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (496)..(496): a, c, t, g, unknown or other
  misc_feature (496)..(496): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanagccaccctctcctgcagggccagtcagagtgttaactactacttagcctggtaccaacagaaacctggccaggctcccaggctcncatctatgatgcatcttacngggccagtgcatcccagccaggttcagtgcaggtggtcctgggacagacttcactctcaccatcagcagcctagacgctagatatttgctagtttatactgtcagcagcgtagcctaactccctagtacgttccggcggacgggaccgaaggtcgagatacaaacgactggagctagcacctatcgtgtcttnacttccgtaccgctatcg

SEQ ID NO: 312635 - DNA, 602 bp, Homo sapiens
  misc_feature: GZ8MTXP02JBJ8Z.22.5.A05.1.454.CMB.2.raw
  modified_base (196)..(196): a, c, t, g, unknown or other
  misc_feature (196)..(196): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccacctctcctgcagggccagtcagagtgttaactactacttagcctggtaccaacagaaacctggccaggctcccgaggctcctcatctatgatgcatctacagggccatgcatccagccagtcagtgcagtggtctggacagacttcactctcaccntcagcagcctagancctagaagtatttagcttagtttactactgtctagctagcgtagactaaccttccctacgtaccggttccgggacgggaacggggaacccgaaaggggttcgggaaacgtaacgtaaccgaaaacggtaaccgttaggtacggggacttaccgggacctaacccgtaacttccggttaacgttcccgtttaccgaactttcccctttacccccggtacctactttaacccgg

SEQ ID NO: 312636 - DNA, 576 bp, Homo sapiens
  misc_feature: GZ8MTXP02GFYBN.22.5.A05.1.454.CMB.2.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (290)..(290): a, c, t, g, unknown or other
  misc_feature (290)..(290): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanagccaccctctcctgcagggccagtcagagtgttaactactacttagcctggtaccaanagaaacctggccaggctcccagctcctcatctangatgcatcttacagggccatggcatcccagccaggttcagtggcaggtggctgggacagtacttcactctcaccatcagcagcctagcgctagaagtatttgcttagtttattacgtgtcagtcaggcgtagacctaacctccctacgtaccggttcgggtagggaacgggaccgtaaagggtcggaagacgtaaccgaaaacgtaacgttggtacggacgtacggaccctaactacttccgtaacgttccttactaccgttccctccccgtacctactttacccg

SEQ ID NO: 312637 - DNA, 587 bp, Homo sapiens
  misc_feature: GZ8MTXP02HK8O5.22.5.A05.1.454.CMB.2.raw
  modified_base (194)..(194): a, c, t, g, unknown or other
  misc_feature (194)..(194): n is a, c, g, or t
  modified_base (224)..(224): a, c, t, g, unknown or other
  misc_feature (224)..(224): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgtctcaggggaaangccacctctcctgcagggccagtcagagtnttaactactacttagcctggtaaccaacagaaacctggccaggctcccaggcctcctcatctatgatgcatctacgagggccagtggcatcccagccaggttcagtggcaggtggtccngggacngtacttcacttctcacatccagcagacctagacgctagaagtatttgcttaagttttatacgttgtacagcgagtacgtacgacctaacctccctacgtaccggttccgggacgggtaacgggaaccgaagggtacgggaagtaacgtaaccgaaaacggtacgtaggtacggacgtacgaccgtacctaagtccgttgttcctttacctacgttcccttccccgacttacgttcccg

SEQ ID NO: 312638 - DNA, 552 bp, Homo sapiens
  misc_feature: GZ8MTXP02GKGC0.22.5.A05.1.454.CMB.2.raw
  modified_base (196)..(196): a, c, t, g, unknown or other
  misc_feature (196)..(196): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaaccaacagaaacctggccaggctcccaggctcctcatctatgatgcatcttacagggccagtggcatcccagccaggttcagtgcaggtggtcctgggacagacttcactctcacatcagcagcctagacgctagaagtatttgacttagtttattactgtacagcgagtcgtagacctaacctccctacgtaccggttcggacgggacgggaccgaagggtcggaagactacgaaaacgtacgtggtacggctcggacacctatcctaagttccttactacgtccttcccgactacttccg

SEQ ID NO: 312639 - DNA, 569 bp, Homo sapiens
  misc_feature: GZ8MTXP02FQ2RX.22.5.A05.1.454.CMB.2.raw
  modified_base (196)..(196): a, c, t, g, unknown or other
  misc_feature (196)..(196): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggctcccaggctcctcatctatgatgcatcttacagggccacgtggcatcccagcctaggttcaggtgcaggtgggcctggggacagtaccttcacttctccaccatcacgtccaagtcctaagacgtcctagaaagtattttgcttagtttattactgtcagcagcgtagacactccctcgacgttcggacggtagggaccgtaagggtcggaagacgtacgaaaacgacgtggcggtactacggccaacccgtatcgtaacgttaccttacgtacttcccgttcccgacctacttaccg

SEQ ID NO: 312640 - DNA, 552 bp, Homo sapiens
  misc_feature: GZ8MTXP02I63AN.22.5.A05.1.454.CMB.2.raw
  modified_base (196)..(196): a, c, t, g, unknown or other
  misc_feature (196)..(196): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggctcccaggctcctcatctatgatgcatctacaggccatggcatcccagccaggttcagtgcagtggcctgggacagacttcactctcaccatcagcagcctagacgcctagaagtattttgctagtttattactgtcagcagcgtagactaactccctcgtacgttcggcgggaacgggaccaaggggtgaacgactaccgaaaacgtacgtggtacggactacggaccaccgattccgtaagttacccttactacttccctttacccgcctaacgttcccg

SEQ ID NO: 312641 - DNA, 517 bp, Homo sapiens
  misc_feature: GZ8MTXP02JZJN1.22.5.A05.1.454.CMB.2.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (384)..(384): a, c, t, g, unknown or other
  misc_feature (384)..(384): n is a, c, g, or t
tcagacatacgcgtcacgaccggtgctcgatttagatagatagacagggggaggaactgctcagttaggacccagaaggaaccatggaagccccagctcagcttctcttcctcctgctactctggctcccagaaaccaccggagaagttgtgttgacacagtctccagccaccctgtctttgtctccgaggggaaanagccaccctctcctgcagggccagtcagagtgttaactactacttagcctggtaccaanagaaacctggccaggctcccaggctcctcatctatgatgcatctacagggccagtgcatcccagccagttcagtgcagtggtctgggcagcttcactctcaccatcagcacgcctagcgctagaagtntttgcttagtttatactgtacagcagcgtagccactccctacgtacgttcggcggtacgggacgaggtgagacgtacgaacgtacgtggtcgactcgaccactagtctcgtctcacttccgtccgactatccg

SEQ ID NO: 312642 - DNA, 555 bp, Homo sapiens
  misc_feature: GZ8MTXP02JCBMH.22.5.A05.1.454.CMB.2.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggctcccaggctcctcatctatgatgcatcttacngggccacgtggcactcccagccaggttcagtgcaggtgggtctggggacagacttcactctcacatcagcagcctagagcctagaagtatttgacttagtttattactgtcagcagcgtagcaacctccctcgtaccggttcgggcgggacgggaccgaagggtcggagacgtacgaaaacgtacgtggtacggctacgacaacctctacgttcgttaccttactacttcccgttacccgacctacttaccg

SEQ ID NO: 312643 - DNA, 508 bp, Homo sapiens
  misc_feature: GZ8MTXP02FN7UP.22.5.A05.1.454.CMB.2.raw
  modified_base (433)..(433): a, c, t, g, unknown or other
  misc_feature (433)..(433): n is a, c, g, or t
  modified_base (487)..(487): a, c, t, g, unknown or other
  misc_feature (487)..(487): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggtaaagagccaccctctcctgcagggccagtcagagtgttaactactacttagcctggtaccaacagaaacctggccaggctcccaggctctcatctatgatgcatcttacagggccactggcatccccagccaggttcagtggcagtgggtcctggggacagacttcactctcaccatcagcagcctagagcctgaaagtattttgctagtttattactgtcagcagcgtaagcaactccctnacgttcgcggagggaccaaaggtggagatcaaaacgaactgtgctgcaccatcngtcttcatcttcccnccnctc

SEQ ID NO: 312644 - DNA, 616 bp, Homo sapiens
  misc_feature: GZ8MTXP02GGUYC.22.5.A05.1.454.CMB.2.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanagccaccctctcctgcagggccagtcagagtgttaactactacttagcctggtaccaacagaaacctggccaggctcccaggctcctnatctatgatgcatctacagggccacgtggcactccccagcccaggttccaggtggcgaggtgggtcctggggacagtaccttcacttctcaccatcagcagcctagacgcctagaagtatttgcttagtttactttacgtgtacagtcagtacgtagacctaacctcccgtacgtaccgggttacgggaccgggaacggggaaccgtaagggggtaggaaacgtacgtaaaccgaaaacggtacgttacggttacggaccgtacggacctaacccgtattccgttcgttacctttacgtacttccctttacccgaccttaacgtttacccg

SEQ ID NO: 312645 - DNA, 564 bp, Homo sapiens
  misc_feature: GZ8MTXP02JXVOW.22.5.A05.1.454.CMB.2.raw
  modified_base (196)..(196): a, c, t, g, unknown or other
  misc_feature (196)..(196): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctaggtaccaacagaaacctggccaggcctcccaggctcctcatctatgatgcatcttacagggccagtggcactcccagcccaggttcaggtgcgtaggtgggtccgtggggacagtacttcacttctccaccatcgagcacgcctagacgccgtagaagtatttagacttagtttattactgtcagcgtagcgtagacactccctgtacgtcgtcgggaggacggacggtaggacgaagtacaacggaacgtaggtcgtacggctacgacctacgtacgtcgttacgttactactaccgttcccgtaccgtactaccg

SEQ ID NO: 312646 - DNA, 596 bp, Homo sapiens
  misc_feature: GZ8MTXP02F9PQR.22.5.A05.1.454.CMB.2.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccacactctcctgcagggccagtcagagtgttagcagcagcttagcctggtaccagcagaacctggccaggctcccaggcctcctcatctatggtncatctacggaggccagtggtatcccagccaggttcaggtggccaggtgggtctggggacaggtagttcactctacaccatcagcacgcctgcagtctagaagtatttgacttagtttattacgtgtaccagtactaacttaattaaacgtaacgtcggtacccttaccggttaacgttaacggttttacggacccggtaacgggggaaccctaaacgggtcgtagggaacgtaaacgttaaccgaaaacgtaacgtggttacggctacggacctaccgtattccgttacggttacctttccg

SEQ ID NO: 312647 - DNA, 603 bp, Homo sapiens
  misc_feature: GZ8MTXP02IH634.22.5.A05.1.454.CMB.2.raw
  modified_base (192)..(192): a, c, t, g, unknown or other
  misc_feature (192)..(192): n is a, c, g, or t
  modified_base (251)..(251): a, c, t, g, unknown or other
  misc_feature (251)..(251): n is a, c, g, or t
  modified_base (299)..(299): a, c, t, g, unknown or other
  misc_feature (299)..(299): n is a, c, g, or t
  modified_base (380)..(380): a, c, t, g, unknown or other
  misc_feature (380)..(380): n is a, c, g, or t
  modified_base (400)..(400): a, c, t, g, unknown or other
  misc_feature (400)..(400): n is a, c, g, or t
tcagacatacgcgtcacgaccggtgctcgatttagatagatagacagggggaggaactgctcagttaggacccagagggaaccatggaagccccagctcagcttctcttcctactgctactctggctccagaaaccacggagaagttgtgttgacacagtctccagccacctgtctttgctcgaggggaaangccacctctcctgcagggccagtcagagttgttaactactacttagcctggtaaccaanagaaacctggccaggctcccaggctcctcatctatgatgcatctacgnggccagtggcatccccgagccctaggttcaggtggctaggtgggtcctaggggactagtacttcacttctcaccatccgancagcctagacgctgaaagtntttgacttagttttacttactgtcagcagtcgtaacgcctaaccgttccctacgtaccggttccgggacgggtaacgggaccgtaaaggggtggaagtaacgtaaccgaaaacggtacgtaggttacgggacttacggaccaacctgttaccgttcgtttaccttacctacttccccgtttaccccgtacctaacgttcccgg

SEQ ID NO: 312648 - DNA, 561 bp, Homo sapiens
  misc_feature: GZ8MTXP02I76O1.22.5.A05.1.454.CMB.2.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (284)..(284): a, c, t, g, unknown or other
  misc_feature (284)..(284): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (419)..(419): a, c, t, g, unknown or other
  misc_feature (419)..(419): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaangcccacctctcctgcagggccagtcagagtgttaactactacttagcctggtaccaanagaaacctggccaggcctccaggctcctnatcatgatgcatctacagggccatgcatcccagcccaggttcagtgcaggtggctgggacngacttnactcncacntcagcagcctagcgctagaagtactttgcttagtttattacgtgtacagcaagtcgtanctaactccctacgtacggttccggacgggtaggaccgtaaagggtcggaagacgtaacaaaacggacgttacgggtacggtactacggaccaacctattcgtcgttcttactaccttcccgtacccgtcctaacgtttcccg

SEQ ID NO: 312649 - DNA, 532 bp, Homo sapiens
  misc_feature: GZ8MTXP02HIJ1X.22.5.A05.1.454.CMB.2.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (380)..(380): a, c, t, g, unknown or other
  misc_feature (380)..(380): n is a, c, g, or t
tcagacatacgcgtcacgaccggtgctcgatttagatagatagacagggggaggaactgctcagttaggacccagagggaaccatggaagccccagctcagcttctcttcctcctgctagtctggctcccagaaaccaccggagaagttgtgttgacacagtctccagccaccctgtctttgtctccaggggaaanagccacctctcctgcagggccagtcagagtgttaactactacttagcctggtaaccaanagaaacctggccaggctcccaggctcctcatctatgatgcatcttacagggccatggcatcccagccaggttcagtgcaggtggtcctggggacagacttcactctcaccatcagcagcctagcncctgaagtatttgctagtttatactgtcagcagcgtagctaactcctcgacgttcggacggaggaccaagggtcgagatacgaaaacgactggtcggctacggacaccctagtccgtgttccttacacttccttccccgactaacgtttccg

SEQ ID NO: 312650 - DNA, 544 bp, Homo sapiens
  misc_feature: GZ8MTXP02FRL9I.22.5.A05.1.454.CMB.2.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
  modified_base (302)..(302): a, c, t, g, unknown or other
  misc_feature (302)..(302): n is a, c, g, or t
  modified_base (374)..(374): a, c, t, g, unknown or other
  misc_feature (374)..(374): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaangccaccctctcctgcagggccagtcagagtgttaactactacttgcctggtaccaanagaaacctggccaggctcccaggctcctcatctatgatgcatcttacngggccacgtggcactccccagcccaggttcagtggcaggtgggtcctggggacagtacttcacttctcaccntcagcagcctaagacgcctagaagtattttgcttagtttattactgtcagcagcgtagccaactccctacgacgttcgggcggacgggaccgtaagggtggagactacgaaaacgactggtcggactcgaccacatcgtcgtcttactacttccttcccacctattaccg

SEQ ID NO: 312651 - DNA, 524 bp, Homo sapiens
  misc_feature: GZ8MTXP02JAOYG.22.5.A05.1.454.CMB.2.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
  modified_base (486)..(486): a, c, t, g, unknown or other
  misc_feature (486)..(486): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccacctctcctgcagggccagtcagagtgttaactactattagcctggtaaccaanagaaacctggccaggctcccgagctcctcatctatgatgcatctacngggccatggcatccagccaggttcagtgcaggtggtcctgggacagacttcactctcaccntcagcagcctagacgctagaagtatttgactagtttatactgtacagcagcgtagacctacctccctgacgttcggacggaggaccgaggtgagatacgaaacgtactggtcgctagaccacgtntcgtgttcctacgtacctccttccccgactacgtaccg

SEQ ID NO: 312652 - DNA, 551 bp, Homo sapiens
  misc_feature: GZ8MTXP02I6O42.22.5.A05.1.454.CMB.2.raw
  modified_base (198)..(198): a, c, t, g, unknown or other
  misc_feature (198)..(198): n is a, c, g, or t
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtcctccgaggggaaanagcccaccctctcctgcagggccagtcagagtgttaactactacttagcctggtaccaacagaaacctggccaggctcccaggcnctcatctatgatgcatctacngggccatggcatcccagccctaggttcagtgcaggtggtcctggggacagtaccttnactctcaccatcagcagcctagacgcctagaatatttgcttagtttacttatgtacagcagtcgtagctaactccctagtaccggttcggacggacgggaaccgaagggtggaagtactacgaaaacgactggtcggactacgaccaacctagttctcgttcttactacttccttacccgctacgttccg

SEQ ID NO: 312653 - DNA, 599 bp, Homo sapiens
  misc_feature: GZ8MTXP02FMX0V.22.5.A05.1.454.CMB.2.raw
  modified_base (255)..(255): a, c, t, g, unknown or other
  misc_feature (255)..(255): n is a, c, g, or t
  modified_base (387)..(387): a, c, t, g, unknown or other
  misc_feature (387)..(387): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccagggtaaagagccaccctctcctgcagggccagtcagagtgttaactactacttagcctggtaccaanagaacctggccaggctccaggcctctcatctatgatgctatctacagggccacgtggcatcccgagcccaggttcagtgcaggtcgggtcctggggacagtacttcacgtctcaccatcagcagcctagacncctagtaagtatttgacttagtttacttacgtgtacagtcagtcgtagcctaaacctccccgtacgtaccggttccggggacgggtacgggaaccgaaagggggtcggaaagtacgtaaaccgaaaacggtacgtaggttacgggctacggacctaaaccgtgttaccgttggttaccttacgtactttacccggtccccacgttatacccg

SEQ ID NO: 312654 - DNA, 593 bp, Homo sapiens
  misc_feature: GZ8MTXP02F3K43.22.5.A05.1.454.CMB.2.raw
  modified_base (198)..(198): a, c, t, g, unknown or other
  misc_feature (198)..(198): n is a, c, g, or t
  modified_base (364)..(364): a, c, t, g, unknown or other
  misc_feature (364)..(364): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgagggggaaangccaccctctcctgcagggccagtcagagtgttaactactacttagcctaggtaaccaacagaaacctggccaggctcccaggcctcctcatctatgatgcatcttacagggccagtggcactcccagccagttcagtgcaggtggtcctgggacagcttcactcncacatcagcagcctagagcctagaagtatttgacttaagttattactgtacagcagtcgtagacctaacttccctacgacggttccggacgggaacgggaaccgaagggtcggaaagtaactaacgaaaacgtacgttcggtacggtactacggaccaaacccgtatttaccggtaacgtttacctttacctaaccgttccccgtttacccccgaccttaacgttaccg

SEQ ID NO: 312655 - DNA, 556 bp, Homo sapiens
  misc_feature: GZ8MTXP02JI1YM.22.5.A05.1.454.CMB.2.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (297)..(297): a, c, t, g, unknown or other
  misc_feature (297)..(297): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgctccaggggaaanagccaccctctcctgcagggccagtcagagtgttaactactacttagcctggtaccaanagaacctgccaggctccaggctctcatctatgatgcatctacnggccatggcatccagccaggttcagtgcaggtggcctgggacagcttcactctcacatcagcagcctagacgcctagaacgtattttgactagtttattactgtcagcagcgtagctaacctccctacgacgttcggacggtacgggacctaagggtcggagacgtaacgaaaacggtaacgtggtacggacttcggaccaaccgtagttccgttaaggttaccttcgtacctttccgttccccgacctacgttacccg

SEQ ID NO: 312656 - DNA, 612 bp, Homo sapiens
  misc_feature: GZ8MTXP02GGMYM.22.5.A05.1.454.CMB.2.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanagccaccctctcctgcagggccagtcagagtgttaactactacttagcctggtaccaacagaaacctggccaggctccagctctnatctatgatgcatctacnggccatggcatcccagccaggttcagtgcaggtggcctggacagacttcactctcacntcagcagctagacgctagacgtatttgcttaagtttactaacgttgttacgagtcgacgtcgtaacgccctaaaccgttccccctaggttacccggttaccggggaccgggtaacgggggtaaccgtaaggggttacggggaacgttaactaacggaaaacggtacgttagggttcggacgtacggtacccaaccgtacttcttaacggtttccttaccgaactttccccgttacccgtacctacgtttacccg

SEQ ID NO: 312657 - DNA, 513 bp, Homo sapiens
  misc_feature: GZ8MTXP02JH4N8.22.5.A05.1.454.CMB.2.raw
  modified_base (192)..(192): a, c, t, g, unknown or other
  misc_feature (192)..(192): n is a, c, g, or t
  modified_base (249)..(249): a, c, t, g, unknown or other
  misc_feature (249)..(249): n is a, c, g, or t
  modified_base (390)..(390): a, c, t, g, unknown or other
  misc_feature (390)..(390): n is a, c, g, or t
  modified_base (487)..(487): a, c, t, g, unknown or other
  misc_feature (487)..(487): n is a, c, g, or t
  modified_base (495)..(495): a, c, t, g, unknown or other
  misc_feature (495)..(495): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccacctgtctttgctccagggaanagccacctctcctgcagggccagtcagagtgttaactactactagcctggtaccaanagaaacctggccaggctcccaggctcctcatctatgatgcatcttacagggccactggcatcccagcccaggtcagtgcaggtggtccctgggacagtacttcactctcaccatcagcagcctagagcctagaagtatttnctagtttatactgctagcagctagcaacgtcctcgacgtcggacggaggacaaggtcggagatacaaaacgacgttgcgacgtcgacacgtacttcngttctacnctccttccgcctaatccg

SEQ ID NO: 312658 - DNA, 690 bp, Homo sapiens
  misc_feature: GZ8MTXP02GU51J.22.5.A05.1.454.CMB.2.raw
  modified_base (197)..(197): a, c, t, g, unknown or other
  misc_feature (197)..(197): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanagccacctctcctgcgagggccagtcagtagtgttaactactacttagcctaggtaaccaacagaaacctggaccaggcctcccgaggcctcctacatctatgatgcattctacgagggccagtggacacgtcccagccctaggttcagtgctaggtcggctaggggacagtacttcaccttctcaacctatccgagccagtacctaagacgtcctaaggaagttattttagactttagtttacttacgtcgtacagacgtacgcgttaacgcctaaacctcccgtacgtaaccgggttacccggacgggggtaacgggtaaccggtaaagggggttacggaaacggtaaacgttaaaaccgaaaaaccgggtaacgttggggttaacggtaccgttacgggaaccctaaccggtaacgtttcttaaccggtttacccttaaccgttaaccctttcccggttaaaccccccgtccttaaaacggtttaccccg

SEQ ID NO: 312659 - DNA, 641 bp, Homo sapiens
  misc_feature: GZ8MTXP02FW8Z3.22.5.A05.1.454.CMB.2.raw
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (361)..(361): a, c, t, g, unknown or other
  misc_feature (361)..(361): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtacccaanagaaacctggccaggctccagctccncatctangatgcatcttacnggggccacgtggcactcccagccaggttcagtgcaggtgggtcctgggacagtacttcnctctcaccatcagcagccctagacgcctagtaagtacttttgaccttaggtttactttacgtgttacgagtacaggtacgtacggtacctaaacccgttcccctaccggtacccgggtttacccgggacggggaaaccgggggtaacccgtaaagggggttacgggaaacggtacgttaaaccgaaaaaccggtacgtaggtacggtacgtacggacctacccgtaagttccttaacggttcctttactaccttcccgttacccgtacctactttacccg

SEQ ID NO: 312660 - DNA, 598 bp, Homo sapiens
  misc_feature: GZ8MTXP02JT92P.22.5.A05.1.454.CMB.2.raw
  modified_base (388)..(388): a, c, t, g, unknown or other
  misc_feature (388)..(388): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaagagccaccctctcctgcagggccagtcagagtgttaactactacttagccttggtaccaacacgaaacctggaccaggcctcccgaggctcctcactctatgatgctatctacgcggccacgtcggcactcccagcccgtaggttcaggtcgcgtagggtcggtcgtcggggacacgtactcactctcaccntcagcagctagacgtctagagttatttgacttagtttactatcgtacgagcaggtactacgacctaccgttccctacgtaccgggttaccgggacgggaacgggtaccggaagggttacggacgtaacaacggaaacgtacggtggtacgggctacggtccaacgtacttcgtaacgttcttactaccttcccgtaccctactacgtacg

SEQ ID NO: 312661 - DNA, 578 bp, Homo sapiens
  misc_feature: GZ8MTXP02GIWQQ.22.5.A05.1.454.CMB.2.raw
  modified_base (197)..(197): a, c, t, g, unknown or other
  misc_feature (197)..(197): n is a, c, g, or t
  modified_base (375)..(375): a, c, t, g, unknown or other
  misc_feature (375)..(375): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaangccaccctctcctgcagggccagtcagagtgttaactactacttagcctggtaccaacagaaacctggccaggctcccaggctcctcatctatgatgcatcttacagggccagtggcactcccgagccctaggttcaggtggctaggtgggtcctggggacagacttcacttctcacntcagcagcctagacgtcctagaagtatttgacttaagtttacttacgtgtacagtcgagtcgtagactaaccgtccctacgtaccggttccgggacgggacgggaccgtaaggggtgaagtacgtaacgaaaacggtacgtggtacggtacgtacgacctacgtattcgtgtcttactcttcccgtaccctccgtacttaccg

SEQ ID NO: 312662 - DNA, 786 bp, Homo sapiens
  misc_feature: GZ8MTXP02IGJNK.22.5.A05.1.454.CMB.2.raw
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaangcccaccctctcctgcgagggccagtcagagtgttaactactacttagcctaggtaccaanagaaacctggccaggctcccaggctcctnatctatcgatgactattcgtacgacgggtccctacgtcgggaccactccccgaaggtcccgtagggtttcgaaggttcggaccgtagggttcggggtcctaggggactacgtacctttcgaccttcctccacccgatccgagccacgtcctaagacgtcctaggtaaagttacgttttacgaagtttaacgttttaactttacgtacggttacgacgtacgtaacgggttaccgtaaccggtaccttaaacccccttcccccgtttaaccgggtacccgggggtttacccgggggaaccgggggttaaacgggaaccccggggtaaaagggggttacgggaaagggtaaaaccgtaacccggtaaaaaaccggtaaagggttcggggttaaaccggtcgtaccggtaccgaaaacccgttactttacccgttcggttttacccttaaccggttaaccctttaccccgtttcccccggtacgttaaaccctttaacccgg

SEQ ID NO: 312663 - DNA, 669 bp, Homo sapiens
  misc_feature: GZ8MTXP02GCLKB.22.5.A05.1.454.CMB.2.raw
  modified_base (198)..(198): a, c, t, g, unknown or other
  misc_feature (198)..(198): n is a, c, g, or t
  modified_base (259)..(259): a, c, t, g, unknown or other
  misc_feature (259)..(259): n is a, c, g, or t
  modified_base (292)..(292): a, c, t, g, unknown or other
  misc_feature (292)..(292): n is a, c, g, or t
tcagacatacgcgtcacgaccggtgctcgatttagatagatagacagggggaggaactgctcagttaggacccagagggaaccatggaagccccagctcagcttctcttcctcctgctactctggcctcccagaaaccaccggagaagttgtgttgacacagtctccagccaccctgtctttgtctccgaggggaaancgccaccctctcctgcagggccagtcagtagtgttaactactacttagcctaggtaccaanacgaaacctggaccaggcctccgaggcctcctnatctatgatgactatctagcgggccagtcggctactcccgaagcccgtaggttcaggtgacggtaggtggggtccaggggacctagtacccgttcaccttcctacacctatcgactcgacgacttacgacgtcctaagtagtactttgactttagttacttactacggtacagtactacggtactaaaccggtcctaacccgttcccgtaccggttaccgggttccggggaaccggggtaacgggggaaccggaagggtagggaacgtaacgtaaaccgaaaacggtaacgttgggaccggtactacggaccctacgtaacggtttccctggtttaccttaaccttacttcccccttaccggacttacggttacccg

SEQ ID NO: 312664 - DNA, 542 bp, Homo sapiens
  misc_feature: GZ8MTXP02IOPZI.22.5.A05.1.454.CMB.2.raw
  modified_base (196)..(196): a, c, t, g, unknown or other
  misc_feature (196)..(196): n is a, c, g, or t
  modified_base (259)..(259): a, c, t, g, unknown or other
  misc_feature (259)..(259): n is a, c, g, or t
  modified_base (290)..(290): a, c, t, g, unknown or other
  misc_feature (290)..(290): n is a, c, g, or t
  modified_base (322)..(322): a, c, t, g, unknown or other
  misc_feature (322)..(322): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
  modified_base (471)..(471): a, c, t, g, unknown or other
  misc_feature (471)..(471): n is a, c, g, or t
  modified_base (488)..(488): a, c, t, g, unknown or other
  misc_feature (488)..(488): n is a, c, g, or t
tcagacatacgcgtcacgaccggtgctcgatttagatagatagacagggggaggaactgctcagttaggacccagagggaaccatggaatccccagctcagcttctcttcctcctgctactctggctcccagaaaccaccggagaagttgtgttgacacagtctccagccaccctgtctttgtctccaggggaaanagccaccctctcctgcagggccagtcagagtgttaaactacgtacttagcctggtaacccaanagaaacctggccaaggcctcccaggctcctnatctatgatgctatctacagggccactggcancccagccctaggttcagtggcaggtgggtcngggacagacttnacttcncacatccagcagcctagacgctagaatagtttgcttagtttntactgttacagctagcgtanaccactccctgtaacgttcggacggaggacgtaagggnggacagtacgaaaacgngtagtcgcgtcgactactattctcgttaccttcaccttccgtcccacgtactcg

SEQ ID NO: 312665 - DNA, 525 bp, Homo sapiens
  misc_feature: GZ8MTXP02FL9XG.22.5.A05.1.454.CMB.2.raw
  modified_base (196)..(196): a, c, t, g, unknown or other
  misc_feature (196)..(196): n is a, c, g, or t
  modified_base (406)..(406): a, c, t, g, unknown or other
  misc_feature (406)..(406): n is a, c, g, or t
  modified_base (427)..(427): a, c, t, g, unknown or other
  misc_feature (427)..(427): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaanagccaccctctcctgcagggccagtcagagtgttaactactacttagcctggtaccaacagaaacctggccaggctcccaggctcctcatctatgatgcatcttacagggccactggcatcccagccaggttcagtgcagtggtcctgggacagacttcactctcaccatcagcagcctagagctgaagtattttgctagtttattactntcagcagcgtagcaactcctnacgttcggcggagggaccaaggtggagtatacgaaaacgacgtgtcggtctgcctaccagttctaagttcttcagttcccttacccgcctacttaccg

SEQ ID NO: 312666 - DNA, 586 bp, Homo sapiens
  misc_feature: GZ8MTXP02H74JI.22.5.A05.1.454.CMB.2.raw
  modified_base (197)..(197): a, c, t, g, unknown or other
  misc_feature (197)..(197): n is a, c, g, or t
  modified_base (383)..(383): a, c, t, g, unknown or other
  misc_feature (383)..(383): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagngccaccctctcctgcagggccagtcagagtgttaactactacttagcctaggtaccaacagaaacctggccaggcctcccaggctcctcatctatgatgacatcttacgagggcccacgtggccatccccagcccgtaggttcaggtggcgtaggtggtccgtggggacagtaccttcgaccttcnccgacatcacgccacgacctagacgtcctagtaaagttagttttcgacttaagttttacgttacttcgtacgagtcgaagtcgtacgacctaccttaccccgtcgtaccggttccggggacggaacgggacgtaaggggtgaagtactaaccgaaacgagtcggcgctagccacatctgttctactcttcctccgtctactcg

SEQ ID NO: 312667 - DNA, 589 bp, Homo sapiens
  misc_feature: GZ8MTXP02JZ8F8.22.5.A05.1.454.CMB.2.raw
  modified_base (197)..(197): a, c, t, g, unknown or other
  misc_feature (197)..(197): n is a, c, g, or t
tcagacatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaanagccaccctctcctgcagggccagtcagagtgttaactactacttagcctggtaaccaacagaaacctggaccaggcctcccgaggcctcctcatctatgatgctatcttacgagggccagtgcactcccagccagttcagtggcaggtgggtcctgggacagtacttcactctcaccatcagcacgacctagacgcctagtagtagtttcgactagtttatactgcagcagcgtacgacctacctcctacgtacggttccgggacgggtacgggaacgtaacggggtggacgacgtacgaaaacgtagtggtacgggtctacggacctaaccgtagttcccgtgtttaccgttacctacgttccccgtttacccgtaccctagtttacccg

SEQ ID NO: 312668 - DNA, 621 bp, Homo sapiens
  misc_feature: GZ8MTXP01A6M3Q.52.13.B02.1.454.CMB.2.raw
  modified_base (222)..(222): a, c, t, g, unknown or other
  misc_feature (222)..(222): n is a, c, g, or t
tcagcgcagtacgacacgaccggtgctcgatttagtctagcgacttccgcgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctctgcactggaaccnggatgatattggtgtcatactatgtctctggtacagcagctccaggacaaacgcccccaaactcatgtattttgatgtacaatacgcgcctcgacgggtcctgctcgctctcgtagctccagtctcggcaacgtacggccctccctgacccattcgtcgtgggcctaccgagtcgtagaggactggagtccttagggtaactttacgtttaccgtcggttactttggtttacctagttttcggaaccgtagggtaccttaaagttcggttaaaccctacgttttaggtacgtttcggtttaaccggggaaaggttcgggggttaacccttaagggtcccggttacctaacccggtttccgtaaacgggttacccaacggttaacccccgtaaaccccgg

SEQ ID NO: 312669 - DNA, 656 bp, Homo sapiens
  misc_feature: GZ8MTXP01BIT5D.52.13.B02.1.454.CMB.2.raw
  modified_base (259)..(259): a, c, t, g, unknown or other
  misc_feature (259)..(259): n is a, c, g, or t
tcagcgcagtacgacacgaccggtgctcgatttagtctagcgacttccgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctctgcactggaacaggagtgattattgggtgtacataactatgtctcgnggtacagcagctaccgaggaccaaacgacccccaaatctatgttattttgatgtacaagtaacgccgcctcgacggggtcctcgactcgtcttactcgtcgtctccgagtccgtacggacctaaccgtacccggtcctacccgtacgtaccctacgtccgtccgtcggcccttacccgagggtaccttagggaggtaacgtggtacggtacgtttagggtactttaagttacctggttccttgttaccttagtttacggaccgtaagggtcttaagtcgttaacttaacgtttagttcggttacggttaaacggggtaacggttccgggaacccttacggtccgtaccgtaacccgttacgtaaacgttcccggaaaccgttccccgtaaaccccgg

SEQ ID NO: 312670 - DNA, 678 bp, Homo sapiens
  misc_feature: GZ8MTXP01AP669.52.13.B02.1.454.CMB.2.raw
tcagcgcagtacgacacgaccggtgctcgatttagtctagcgacttccgcggggggggtctcaggaggcagcactctcgggacgtctccaccatggcctgggctctgctcctcctcagcctcctcactcagggcacaggatcctgggctcagtctgccctgactcagcctcgctcagtcggtccgggtctccgtggacagtcagtcaccatctcctgcacgtcggaaccaggagtagattagttgggtgtacataactatcgtctcgtggtaccagcacgcctaccgaggaccaaaccgaccccctaaagtcattagttattttagattagtacaaagtacggcccgtacccgtcggacgggtcctacgactcgtcttcgtcgtacgcctaaccgaggtccgtacgggacccaaccggtcccgggcccctacccgtacgacccttacgtccgtcgtccgggtctacccggagggtcctagggacggtagtaggacgtcttaggggttaactttacgttaccgtgtctttcggttactgtttcggacgtaggtaccttatacgtaactttacgttaggttcggttaccgttaaacggggacggttccgggaccgttacggtcccgtaccgtaacccgtttaacgaacggttccgaaccccggttaacccgtaaaccccg

SEQ ID NO: 312671 - DNA, 634 bp, Homo sapiens
  misc_feature: GZ8MTXP02F7X54.52.13.B02.1.454.CMB.2.raw
tcagcgcagtacgacacgaccggtgctcgatttagtctagcgacttccgcggggggggtctcaggaggcagcactctcgggacgtctccaccatggcctgggctctgctcctcctcagcctcctcactcagggcacaggatcctgggctcagtctgccctgactcagcctcgctcagtgtccggtctccgtggacagtcagtcacatctcctgcactggaaccaggagtgatagttggtgtcataactatgtctctggtacagcagcctaccaggaccaaaccgacccccaaatcatgtattttgatgtacaagtacggccgtccgtcgtacgggtcctgtactccgtcttcctcgtacgtcctaccgtaacgtcctacgacccgtaaccgacccggtccctaccctacgaccctacgtcctcggtcggcctaccgcggtactaggacggtagtcgacggtctagtaacttacttacgtgttcgttgttaccttagttcgacgtacggtctacgttacttaacgttcgttaagttcggtttaacggtacggttaacgggaccggtaccgacggttaacccggtacccgtaaccggttacctaacggtacccacccggtaacccgtaaaccccgg

SEQ ID NO: 312672 - DNA, 683 bp, Homo sapiens
  misc_feature: GZ8MTXP02FI7XB.52.13.B02.1.454.CMB.2.raw
  modified_base (260)..(260): a, c, t, g, unknown or other
  misc_feature (260)..(260): n is a, c, g, or t
  modified_base (309)..(309): a, c, t, g, unknown or other
  misc_feature (309)..(309): n is a, c, g, or t
tcagcgcagtacgacacgaccggtgctcgatttagtctagcgacttccgcggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgacagtcagtcaccatctcctgcactggaaccaggagtgatattgggtgtcatatatgtctctgtacngcagcctccgaggaccaaaccgacccccaaactcattgtattttgattntacaataacggccgtccctacggtacgggtcctacgtactccgtcttaccgtcgtcggtacctacgaacgtccgtaggtaccaaccgtaccggtcccttacccgtgaaaccccttatcccgtacggtcccggtacccgttacccggaggggtacccgttagggtaccggtacgtagggtaaaccgggtcgttaaggtttaactttaacgttacgttcggtaccgtttacgtttacgtacgttttcggacgttaacgggccttaaaaggttccgttaaactacgtttagttcggtacgttacggggaaacggttcggaccgtacggtccgtaccgtaacccgttacgaacgtaccgaccggtacccgtaaacccg

SEQ ID NO: 312673 - DNA, 556 bp, Homo sapiens
  misc_feature: GZ8MTXP02HT901.41.33.C11.1.454.CMB.2.raw
  modified_base (312)..(312): a, c, t, g, unknown or other
  misc_feature (312)..(312): n is a, c, g, or t
  modified_base (449)..(449): a, c, t, g, unknown or other
  misc_feature (449)..(449): n is a, c, g, or t
tcagtctatactatcacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggaggtccctgagactctcctgtgtagcgtctggattcaccttcaacagacatggcatgcacgtcggggtcccnccaggcctaccgaggaccaaaggggactggggaggtggggtggcactttatagtggtaatgagtaggaaagtaaataattattatgtagtattcgtagaacggccgtattcaccatctacagagaactaatacgaanaacacactaatactagagtaaatagaatacgctagagacgaccgagacacggctagtactacgtactgtgacgagaagtggtcgggggtcctaggtggaatacgaag

SEQ ID NO: 312674 - DNA, 694 bp, Homo sapiens
  misc_feature: GZ8MTXP02IAKZS.41.33.C11.1.454.CMB.2.raw
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
tcagtctatactatcacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctgggtggagtcgtgggggagcgtggtccagccgtgggagtccctgagactctcctgtgtagcgtntggattcaccttcaacngacatggcatgctacgtcgggtccgccgaggcctcccgaggtaccgaaaggggtacctggggtacggttggggtgggtaccctaaagttttagaacgtttggggtattaggaagttagggtaaaagtttaaaattaaagtttatttaaagtacggttaaagttacgtttacggggtaggaaacggggtcccgtaagttacccgtaacccacttacccacccgtaagaacgtaactaaacgttaccgaaaacgtaacaaaccgtaaacttaaacttaacgttacgtaagggtaaatacgtaaatacgtacgtaggaacggacgaccggaagggaaccaccgggtctacgttcctaaacgtacgttcgacgtagaggaagtacggtacggggtctacggtagactacgaag

SEQ ID NO: 312675 - DNA, 602 bp, Homo sapiens
  misc_feature: GZ8MTXP02I9W3W.41.33.C11.1.454.CMB.2.raw
  modified_base (321)..(321): a, c, t, g, unknown or other
  misc_feature (321)..(321): n is a, c, g, or t
  modified_base (370)..(370): a, c, t, g, unknown or other
  misc_feature (370)..(370): n is a, c, g, or t
  modified_base (403)..(403): a, c, t, g, unknown or other
  misc_feature (403)..(403): n is a, c, g, or t
tcagtctatactatcacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggaggcggtggtccaggccgtggggacggtccctgacgactctcctgtgtagcgtctggtacttccaccttcaaacagacatggcatgcacgtgggtcccnccaggcctaccgaggacgaaggggactggggagtggggtagactattanagtggtatgataggaaataatatatatacgtanattcggagacggtcgattcactatctaccaagacgaactaagtacgaaacgaactaactaactaatacgtacgtaagggtaaataacgtaatacgacctaggaacgacggaccgaaggaccgaacgggtctagttacctaactacgtggtacgacggaaggaaggtaggtcgggggtcctaggtaggtacgaacgtaag

SEQ ID NO: 312676 - DNA, 617 bp, Homo sapiens
  misc_feature: GZ8MTXP02IR31X.41.33.C11.1.454.CMB.2.raw
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
tcagtctatactatcacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtggggaggcgtggtccagccgtgggaggtccctgacgactctcctgtgtagcgtctggattccaccttacaacagacagtggcatgacacgtcgggtccccgcgaggcctaccgaggaccgaaagggctgggnggttcggggtgactactttanagtggtatgagtaggaaattaaattaaaattatttagtgttaaagtacgttaccgtaggaaacggggtcctacgttaccacctagtccaccgaagaagaactaaagttacgaaacgaacaacacttaataatcgtaaagaaagttcgaaagtacgaccgtagaggtacgacggacggtaaccgacgtctacgtcctactacgtgtacgacgtagaaggtgtaaggcgtacgtacggtaacacgaagtactacg

SEQ ID NO: 312677 - DNA, 691 bp, Homo sapiens
  misc_feature: GZ8MTXP01EM62M.25.21.B10.1.454.CMB.2.raw
  modified_base (388)..(388): a, c, t, g, unknown or other
  misc_feature (388)..(388): n is a, c, g, or t
tcagactgtacagtcacgaccggtgctcgatttagtgtcgtcgcaagagaggaggagccttagccctggattccaaggcctttccacttggtgatcagcactgagcaccgaggattcaccatggagtgggctccgcttgggttttccttgtcgcttattttagaaggtgtccagtgtgaggtggtgcgtggtggagtcgtggggggaggcctggtcaaggccgtcggggggtcccaagactctcgttgtgcacgtcctctggtattaccgaacttcgaaaggctaacagactatagaactggactccgcgaggccgtaccggggaaggtcctgcgtagtgtattcactcctagttaggtgtacttaagcgtagtaactaaattttagngagacgtacgtacgggtacgtaaccgggtccgttaccacctatcctacgagacacccgaaccgccggtacttactttccttctttacgtacgaacctaagtacgaacacgtaccagacgggaacggtcccggaacggacgtaacccgtgtttacgtttacgtttcgtggttacggacggtaggtaggggtaagggtaggggttaaaccgtaaacggttggtaccgttaccggttacgggttggttacgtaacgttgttccgttttaggacggttttacggaacggggttaacccgtaaagggg

SEQ ID NO: 312678 - DNA, 632 bp, Homo sapiens
  misc_feature: GZ8MTXP01DDC39.25.21.B10.1.454.CMB.2.raw
  modified_base (374)..(374): a, c, t, g, unknown or other
  misc_feature (374)..(374): n is a, c, g, or t
tcagactgtacagtcacgaccggtgctcgatttagtgtcgtcgcatgagagaggagccttagccctggattccaaggcctttccacttggtgatcagcactgagcaccgaggattcaccatggaagtgggctccgctgggttttccttgtcgctattttagaaggtgtccagtgtgaggtggtgcgtggtggagtcgtgggggaggcctggtcaagccgtgggggtcccaagactctcttgtgcagcctctggattcaaacttcaaaggctacagcatgaactggactccgccaggcgtaccgggggaaggtctgcgaggtggtatttcattcctaagttagtggttacttaaagcgtagtaacctaaattttngacaagtaacgtcgggtggaaaccgggtcccggttacaccgtactaccgtaccgaacgacgaaccgaaccgacccgtaacgttacctttccttcctttactacgtaacctaaatacgaaacacgcctacgacgacgaccgacggacgacgtcttagttttacttcgtgtgcgaggaaggaggttagggacgaaacgtcggtacttacgttacgggagtgtagttgttcgtttgttacgtttcggttcggggtaaccgg

SEQ ID NO: 312679 - DNA, 556 bp, Homo sapiens
  misc_feature: GZ8MTXP02GJGLE.25.21.B10.1.454.CMB.2.raw
  modified_base (351)..(351): a, c, t, g, unknown or other
  misc_feature (351)..(351): n is a, c, g, or t
tcagactgtacagtcacgaccggtgctcgatttagtgtcgtcgcaagagaggaggagccttagccctggattccaaggcctttccacttggtgatcagcactgagcaccgaggattcaccatggaagtggggctccgctgggttttcctgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgcaggctccggggaaggtctgcagtggatttcatccattagtggtcttaagctgacaatttangcagactcggtgacgggtccgttcaccatctaccagacgacacgccgacgactttctcgttctgacaatagaacagctacagacgcgaggacacggtctgtttattctgtgtcgagaggaggtacggggacgaaaacgtgggactcgtaacggtaggtagaagttggtacgttttcggtagtttcgtacggggtaccgtaaaggg

SEQ ID NO: 312680 - DNA, 625 bp, Homo sapiens
  misc_feature: GZ8MTXP02HJDRJ.25.21.B10.1.454.CMB.2.raw
  modified_base (319)..(319): a, c, t, g, unknown or other
  misc_feature (319)..(319): n is a, c, g, or t
tcagactgtacagtcacgaccggtgctcgatttagtgtcgtcgcaagagaggaggagccttagccctggattccaaggcctttccacttggtgatcagcactgagcaccgaggattcaccatggaagtgggctccgctgggttttccttgtcgctattttagaaggtgtccagtgtggaggtggtgctgggtggagtcgtgggggaggcctggtcaagccgtggggggtcccgaagactctcttgtgcagcctctggattccaacttcgaaaggctaacagcatgaaactggactccgcaggcgtaccggggaaggtcnggcaggtggactttcgactcctagtttagtggtacttaaagcgtagtaactaaaactttttgacgctaagtacgttcggggtaggaccgggtcccggttacaaccctactcctaccgagaacgaccgaaaccgccgtaacgtactttcttctttctacgacctaaatcgaacacgactacgaagacgaccgaggaccgaggtcttagtttacttcgtagtgacgaggtagggtggtaggggaaccgaaaacgtcggactacgacggagtgaagtcgtcgtttgagtttcggacgggacgtaacggg

SEQ ID NO: 312681 - DNA, 596 bp, Homo sapiens
  misc_feature: GZ8MTXP02JYHUM.25.21.B10.1.454.CMB.2.raw
  modified_base (324)..(324): a, c, t, g, unknown or other
  misc_feature (324)..(324): n is a, c, g, or t
  modified_base (358)..(358): a, c, t, g, unknown or other
  misc_feature (358)..(358): n is a, c, g, or t
  modified_base (496)..(496): a, c, t, g, unknown or other
  misc_feature (496)..(496): n is a, c, g, or t
tcagactgtacagtcacgaccggtgctcgatttagtgtcgtcgcatgagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccaagactctcttgtgcagcctctggattcaacttcaaaaggctacagcatgaactggactccgcaggcgtcggggaaggtctgcagtggatttnatccattagtgtacttagcgtagaactaatttangacagactcgggtagaccggtccggttacaccattccacagagacaaccgccgacgtactttctcttctgaactaaagtgaacacgccctagacggacgacccggaggtaccgacggttaccgtttgtttatttccgnggttacgaggagtacgggtaggtagggaaccgtaaagcggtacgtaccgaagggaggtgtaggttcgttcgtttagtacgtttccggacggggtaaccgg

SEQ ID NO: 312682 - DNA, 602 bp, Homo sapiens
  misc_feature: GZ8MTXP02FE3NY.25.21.B10.1.454.CMB.2.raw
  modified_base (250)..(250): a, c, t, g, unknown or other
  misc_feature (250)..(250): n is a, c, g, or t
  modified_base (372)..(372): a, c, t, g, unknown or other
  misc_feature (372)..(372): n is a, c, g, or t
  modified_base (446)..(446): a, c, t, g, unknown or other
  misc_feature (446)..(446): n is a, c, g, or t
tcagactgtacagtcacgaccggtgctcgatttagtgtcgtcgcaagaggagaggagccttagccctggattccaaggcctttccacttggtgatcagcactgagcaccgaggattcaccatggaagtggggctccgctgggttttcctgtcgcttattttagaaggtgtcagtgtgaggtggtgctgggtggagtcgtgggggagcctggtcaagccgtggggggtcccaagctctcttgtgcagcctntggattcaacttcaaaggctacagcatgaaactggactccgcgaacggcgtccggggaagggtctgcgagtggtatttcgattaccgattagtgggttacttaaagcgtgaactaaattttngctagacgtcgggagtaccggtccggtacacctatcctaccagacaccgaacgcccgtactactttctctttcngacaaaatgaaactcgaccacgagacggccgtaggaccgtaggtccttggttttacttacgtggccgtaggtaggaaggacgggtagggacggaaacgtacggcgtacgtacggtaggtagtaagtgtcgttcgtagttcgtacgggccggaacgg

SEQ ID NO: 312683 - DNA, 354 bp, Homo sapiens
  misc_feature: GZ8MTXP01BRLXW.13.29.C07.1.454.CMB.2.raw
  modified_base (349)..(354): a, c, t, g, unknown or other
  misc_feature (349)..(354): n is a, c, g, or t
tcagtcacgtactacacgaccggtgctcgatttagagtgctacgaagggaaagggtcaccattaccagggacatgtccacagccacggcctacatggagttgagcagcctgagatccgaggacacggccgtgtattattgtgcgagagatggggcccacgaacgttactacgctatggacgtctggggccaagggaccacggtcaccgtctcctcagcctccaccaagggcccatcggtcttcccctggcgccctgctccaggagcacctccgagagcacagcggcctgggctgcctggtcaaggctacttcctagtacgtgactgagcgggctggcaaggcgcatagnnnnnn

SEQ ID NO: 312684 - DNA, 354 bp, Homo sapiens
  misc_feature: GZ8MTXP01BVJB6.13.29.C07.1.454.CMB.2.raw
  modified_base (262)..(262): a, c, t, g, unknown or other
  misc_feature (262)..(262): n is a, c, g, or t
  modified_base (349)..(354): a, c, t, g, unknown or other
  misc_feature (349)..(354): n is a, c, g, or t
tcagtcacgtactacacgaccggtgctcgatttagagtgctacgaagggaaagggtcaccattaccagggacatgtccacagccacggcctacatggagttgagcagcctgagatccgaggacacggccgtgtattattgtgcgagagatggggcccacgaacgttactacgctatggacgtctggggccaagggaccacggtcaccgtctcctcagcctccaccaagggcccatcggtctcccctggcgcctgctccaggngcacctccgagagcacagcggcctgggctgcctggtcaaggactacttcctagtacgtgactgagcgggctggcaaggcgacatagnnnnnn

SEQ ID NO: 312685 - DNA, 546 bp, Homo sapiens
  misc_feature: GZ8MTXP01BGVDJ.39.16.B05.1.454.CMB.2.raw
  modified_base (301)..(301): a, c, t, g, unknown or other
  misc_feature (301)..(301): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctatttagaaggtgtccagtgtgaggtgcagctggtggagtcgtgggggaggcttggtccagccgtggggggtccctgagactctcctgtgcagcctctggatcacctttaggaactatggatgagttgggtccncaggctgcgaggggagggctgggagtgggtggccaacgagtaggaggtagatgggaaagagaaagaaatcgtatggtagggactcgtggtagaaagggccgattcaaccatcctccaagacgacaacgaccaaagaattcactaggtaatttacaaatgaacagcctgagagccgagacacgtctgttatacttgtgtgacggaagggggcaaggtgcgtgggcttacggtcgggccaaccgggg

SEQ ID NO: 312686 - DNA, 543 bp, Homo sapiens
  misc_feature: GZ8MTXP01EHO28.39.16.B05.1.454.CMB.2.raw
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (538)..(538): a, c, t, g, unknown or other
  misc_feature (538)..(538): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggtttccttgttggtatttagaggtgtccagtgtgcggtgcagttggtggagtcgtgggggaggcttggtccaggccggggggtcctgagactctcctgtgcagcctctggacttccccttagagtattggctgagctgggtccncaggctcgagggagggttgagtggtgcaanataagcaagatggaagtccggaaagagtatctggaactgtggtggagggggtcccgttcaccatctaccagagacaacgccaaagaacctccgtgcatctgacaaaagtgaaacngttcngagacgccgaggacacggtcttgtttatcgngcgngagaggaggcgtgggttcgttcgacgtcggcgggccgacgggtacccttggtccnccgtc

SEQ ID NO: 312687 - DNA, 561 bp, Homo sapiens
  misc_feature: GZ8MTXP01EWSBR.39.16.B05.1.454.CMB.2.raw
  modified_base (339)..(339): a, c, t, g, unknown or other
  misc_feature (339)..(339): n is a, c, g, or t
  modified_base (485)..(485): a, c, t, g, unknown or other
  misc_feature (485)..(485): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggatcacctttaggactattggatgagttggtccgcaggctgcgagggaggggctgggagtggggtgccaanagtaggaggtagatagggaagagaaagaaataacgtatggtaggactcgtggaggaagggcccgattcgacatctaccagacgaacaacgacaaagattacactggttaatttaacaaatcgaacagcctagagagccgaaggacncgtctgttatacttagttgtgacgggaaagggggcaagggtggcgtggggcttacggtcgggggccgaacccgggg

SEQ ID NO: 312688 - DNA, 638 bp, Homo sapiens
  misc_feature: GZ8MTXP01DLH5D.39.16.B05.1.454.CMB.2.raw
  modified_base (284)..(284): a, c, t, g, unknown or other
  misc_feature (284)..(284): n is a, c, g, or t
  modified_base (466)..(466): a, c, t, g, unknown or other
  misc_feature (466)..(466): n is a, c, g, or t
  modified_base (625)..(625): a, c, t, g, unknown or other
  misc_feature (625)..(625): n is a, c, g, or t
tcagtcgcactagtcacgaccggtgctcgatttagagctcacgtatttgggtttgggggtcagacccagtcaggacacagcgtggacatgagggtccccgctcagctcctggggctcctgctgctctggttcccaggttccagatgcgacatccagatgacccagtctccatcttccgtgtctgcatctgtaggagacagacgtcacatcacgttggcgggcgagtcgagggtattagcagtcgtggttacgcctggtatcagacaagaaaccgaagggaaacncccctaaagcctactgaactctatgctgctacttcctgtttcgaacgtaaacggttcgggtacccagttaccgtaaacggttcagtcgggactaggtaggacgttcgtaggggaactaagttactttccaactcttacccacatacacgcacgtcctggactaacgccttaaggtaaacttntttttacgaactttaacgtttatttaacgttacgtaacgaacgtaacgtaccgtttaaacgtaccggtttaccccggaagggtaccgtacggaaccggaaacgggaacgaaagggtacgaaactacggaaaacgacgttggttgaacgtcaacacctancttcgttcttaac

SEQ ID NO: 312689 - DNA, 541 bp, Homo sapiens
  misc_feature: GZ8MTXP01DPI7O.39.16.B05.1.454.CMB.2.raw
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
  modified_base (469)..(469): a, c, t, g, unknown or other
  misc_feature (469)..(469): n is a, c, g, or t
  modified_base (488)..(488): a, c, t, g, unknown or other
  misc_feature (488)..(488): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtggggaggcttggtccagccgtggggggtccctgagactctcctgtgcagcctctggatcacctttaggaactattggatgagttgggtccgccaggctgcgaggggaggggctgggagtggggtggaccaaagagtaggaggtagatggaagagaaagaaatctatgtggactcgtgtgaagggccattcacatctacagagaacacgcaaagattcactgtaatttacaaatgaacngcctgagngccgaggacngtctgttatacttagtggngacgggaaagggggcaagggtggcgtgggcttacggtcggggccgaaccgggg

SEQ ID NO: 312690 - DNA, 636 bp, Homo sapiens
  misc_feature: GZ8MTXP01ATYRS.39.16.B05.1.454.CMB.2.raw
  modified_base (568)..(568): a, c, t, g, unknown or other
  misc_feature (568)..(568): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (605)..(605): a, c, t, g, unknown or other
  misc_feature (605)..(605): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgtggtttcttgttgctatttagaaggtgtcagtgtgaggtgcagcgtgggtggagtcgtgggggagcgttggtccaggccgtggggggtccctggagactctcctgtgcagcctctggactcaccttaggaacttagttggatggtaggttcgggtccgccgaggcgtggacggaagggggacgggggcgtagggggtaggtcgggggtacggacccaaagtaggtaggaaggttaaggagtagggaaagaaggaaaacgtaaattgtagtgggtaggtacgtcgtaggtagggaaacgggtccgtattaccacctatcctacgaagacgaaccgaacgaccaaagtacttaccgtaagttaggtttaatttaaacaaagttacgaacagtccgagaaggcgacggacgactcggtntagttatacttagttgacggaggggacggggngnggnggcggtggcgttacggtcgggccggaacggg

SEQ ID NO: 312691 - DNA, 542 bp, Homo sapiens
  misc_feature: GZ8MTXP01DJDMI.39.16.B05.1.454.CMB.2.raw
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
  modified_base (384)..(384): a, c, t, g, unknown or other
  misc_feature (384)..(384): n is a, c, g, or t
  modified_base (411)..(411): a, c, t, g, unknown or other
  misc_feature (411)..(411): n is a, c, g, or t
  modified_base (457)..(457): a, c, t, g, unknown or other
  misc_feature (457)..(457): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggatcaccttaggaactattggatgagttgggccncaggctgcgaggggaggggctgggagtggggtgccaanataggaggtagatgggaaagagaaagaaatctatgtgggactntggtgaagggccattcacatctcaganacaacgcaaagattacactgtaatttacaaatgaacagcctgaagngccgaggacagtctgttatacttagttgtggacggaagggggcaaggtggcgtggggcttacggtcgggggcccgtaaccggggg

SEQ ID NO: 312692 - DNA, 667 bp, Homo sapiens
  misc_feature: GZ8MTXP01ATI2K.39.16.B05.1.454.CMB.2.raw
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctgggtggagtcgtgggggagcttggtccaggccgtgggggtccngngactctcctgtgcacgctctgtntctacttagtactatgtntgtagtggtcgcgngngtgngaggagggngtggnggtggtggcacagagaggagagaggaagaagaaagaaataactagtagtggtacgtcgtggtagaaggggcccgtattccaccgaacttcgtacccgaagaacgaaccaaaccggaccgaaataaagttcctaaccttagggtttaaactttaaactaaaacgagtaaacgacgtcccgttagggaaacggacggtacccggaaggtaacccgtcgttaaccgttagttaaataaccttttaggttgggtacggggaaccgggggaaaaggggggaccgtggtcgggtccggtcggggttacccggttacgggttcccgggggaaccgggaaaccccccggggg

SEQ ID NO: 312693 - DNA, 527 bp, Homo sapiens
  misc_feature: GZ8MTXP01BSLOG.39.16.B05.1.454.CMB.2.raw
  modified_base (303)..(303): a, c, t, g, unknown or other
  misc_feature (303)..(303): n is a, c, g, or t
  modified_base (339)..(339): a, c, t, g, unknown or other
  misc_feature (339)..(339): n is a, c, g, or t
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggagcttggtccagccgtggggggtccctgagactctcctgtgcagcctctggatcaccttaggaactattggatgagttggtccncaggctgcgagggagggctgggagtggggtgccaanataggaggtagatggaaagagaaagaaatctatggtggactgtgtggaagggctatcacatctcagagacaacgcaagatcactgtatttaacaatgaacngcctgagagccgagacncgtctgttatacttagtgtgacggaaagggggcaaggtggcgtgggcttacgtcggggccgaacccgggg

SEQ ID NO: 312694 - DNA, 750 bp, Homo sapiens
  misc_feature: GZ8MTXP01BXFS8.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcgttggtccagccgtgggggtccctgagactctcctgtgcagcctcgtggatcacttaggaactattggatgagttgggtccgccaggctgcgagggagggctgggagtgggtgcaacagtagaggtagagtaggaaagagaaagaaataacgtagtggtgggactcgtaggtaggaaacggggcccgtaagtttccaacctacttccgtacccgaaacggaacgaaaccgaaaccgaccgaaaaggtaaactttaccgtaaccgtttaggggtttaaactttttaaacaaaaacgtttacgaaaaccgtaacgtaccccgttaagggaaaggaaccggaacccgggaaacgggtaaacccgtaaccggtttcccgtttaaggtttaaacctttaaaccgtttaacgttttagggttacgggttaacccgggggaaaaaggggggggttcccgtaaggggtttcgggggaaccggtttcggggggaccgttaccggggtcggggggaaccccggttaaaccccccgggggg

SEQ ID NO: 312695 - DNA, 596 bp, Homo sapiens
  misc_feature: GZ8MTXP01BINYP.39.16.B05.1.454.CMB.2.raw
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (477)..(477): a, c, t, g, unknown or other
  misc_feature (477)..(477): n is a, c, g, or t
  modified_base (510)..(510): a, c, t, g, unknown or other
  misc_feature (510)..(510): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtgggtggagtcggtgggggaggtcgttggtccaggccggttggggggtccctgagtactctcctgtgcagcctcgtggactcaccgtttaggaactagttggatggaggttcgggtcccgcgaggctggacggaagggggaggggcgtgggaggtgggggtacgaccaaagagtaggaggtagagtaggaagagaaanaaatntatgtagactgtggtagaacgggctatcacatcncaaganacacgaccaagtatcactagttaatttaaanaatagaacagctagaagcgcggaagactacgtntgttaatacgttagttagagaacggttaagggttcggggaactagggtgggacggtgggaccttaacgggttcgggggaaccccgg

SEQ ID NO: 312696 - DNA, 548 bp, Homo sapiens
  misc_feature: GZ8MTXP01DXZVB.39.16.B05.1.454.CMB.2.raw
  modified_base (341)..(341): a, c, t, g, unknown or other
  misc_feature (341)..(341): n is a, c, g, or t
  modified_base (501)..(501): a, c, t, g, unknown or other
  misc_feature (501)..(501): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggatcaccttaggaactattggatgagttggccgccaggctgcgaggggaagggcgtgggagtggggtgaccaanagtagaggtagatggaagagaaagaaatctatggtggactcgtggtaggaagggccgattcaacatctacagagaacaacgaccaaagaatacactagttaatttacaaaatgaaacagcctgaacgagaccgaggacacgtctgttatacttagtgtgnggaaagggggcaaggtggcgtgggcttacgtcggggcgaacccgggg

SEQ ID NO: 312697 - DNA, 647 bp, Homo sapiens
  misc_feature: GZ8MTXP01CYZIL.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcgttggtccaggcccggtggggggtccctggagactctcctgtgcagcctctggtatcaccttaggaactagttggatgagttcggtccgcgaggctgcgaagggaggggctgggaggtgggtgaccaaacagtaggaggtagagtaggaaagagaaaacgaaataacgtagtggtagggactcgtaggtaggaaacgggccgtaattccgaacctatcctacccgaagacgaacaaaccgaccaaagaacttacaaccgttaggttaaactttaaacctaaaagttacgaaacgacgaccgtagaaacggacgaccggaaggacctacgtaactaggttaatacttagttaggtggaacggggttaagggggactaagggtcggcggtgggcgttacgggtcgggggaacccgtaaccccggggg

SEQ ID NO: 312698 - DNA, 770 bp, Homo sapiens
  misc_feature: GZ8MTXP01CVE6Y.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcagcgtgggtggagtcgtgggggaggtcgttgggtccaggcccggttgggggggtccctggacgacctctccgtgtgcagcctcgtggattcaacctttaggaactattggatggtagttgggtccgcgaggctggcgagggggaaggggctggggagtgggggtcgccaaacagtagaggtagagtggaaagagaaagtaaataacgtagtggttaggactcgtagggttacgggaaacgggggtcccgtaatttacccaacccgtaacgttcccgtacccgaaaggaaaccggaaaccgaaaccccgggtaacccaaaaggttaaactttacctaaacgtttacggggtttaaaacttttaaacccgtaaaaagttacggaaaaccgtacggaccccgttaggaaacggaacggtacccgggaaacgggaacctaccggttaacgtacggttaaattaaccttaggtttacggtagggacgggggaaaagggggggttctaagggggttacgggcggttacgggggtccggttaccgggtcggggggttaaccccggtaaaccccgggggg

SEQ ID NO: 312699 - DNA, 759 bp, Homo sapiens
  misc_feature: GZ8MTXP01BOY0K.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggagtcttggtccagccgtgggggtccctgagtactctcctgtgcacgcctcgtggtactcctaccgttaggaactagttggatggtaggttcgggtcccgccgaggtcgtggacggtaagggggacgggggtcggtgggggagggttcgggggtacggaccgaaacgtaggtaagggtaaacggggtaaggaaggtaaggggaaaggaaaggaaaaaagtaaaagttaacgttagtagggtacgggtacgtcgtagggtagggaacggggtacccgtagttaccaacctacttacctaccaaggaacgaaccaaccgaccaaagtaacttactacgttaaggttaaactttaaacaaattacgaaactacgtacccgtaggaacggacgaccgggaaggaaccctacggttaactaaggttaacttaacgttaggtttacgggacgggttaacggggggaaacggggggttacgtaaggggttacgggcgttacgggggacgttacggggtaacccgggggaacccgggtaaaccccggggg

SEQ ID NO: 312700 - DNA, 627 bp, Homo sapiens
  misc_feature: GZ8MTXP01DLHXI.39.16.B05.1.454.CMB.2.raw
  modified_base (452)..(452): a, c, t, g, unknown or other
  misc_feature (452)..(452): n is a, c, g, or t
  modified_base (533)..(533): a, c, t, g, unknown or other
  misc_feature (533)..(533): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctgggtggagtcgtgggggagtcgttggtccaggcccggtggggggtccctggacgactctcctgtgcagcctcgtggatcacctttaggaacttagttggatggagttgggtccgcgaggctggacgaagggggaggggcgtgggaggtggggtggacccaaagagtaggaggtagagtagggaaagagaaagaaatcgtagtggtaggactcgtggtagggaacgggccgattccaccatccacaaganacaacgaccaaagtacttacacttaggttaactttaacaaaagtcgaaacacgccgtaggaagacgtaccggaaggaaccnccggttaatcggttaattacgttagttggtacgggaacgggaagggggctaagggtggcgtggggcttacggtcggggaacccgtaacccgggg

SEQ ID NO: 312701 - DNA, 553 bp, Homo sapiens
  misc_feature: GZ8MTXP01EPCKD.39.16.B05.1.454.CMB.2.raw
  modified_base (333)..(333): a, c, t, g, unknown or other
  misc_feature (333)..(333): n is a, c, g, or t
  modified_base (454)..(454): a, c, t, g, unknown or other
  misc_feature (454)..(454): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
  modified_base (495)..(495): a, c, t, g, unknown or other
  misc_feature (495)..(495): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggagtcgttggtccagccgtgggggtccctgagctctcctgtgcagcctctggatcactttaggactattggatgagttggccgccaggctgcgaggggagggctgggaggtgggngaccaagagtaggaggtagagtaggaagagaaagaaatctatgtagactgtgtgaacgggccattcacatctaccagacgacaacgacaagattcacttaggttaatttaacaaatgaacngcctagaagngccgaggacncgtctgttatacttagttggnggacgggaagggggcaagggtggcgtgggcgttacggtcgggggccgtaacccggggg

SEQ ID NO: 312702 - DNA, 518 bp, Homo sapiens
  misc_feature: GZ8MTXP01EAOQU.39.16.B05.1.454.CMB.2.raw
  modified_base (299)..(299): a, c, t, g, unknown or other
  misc_feature (299)..(299): n is a, c, g, or t
  modified_base (333)..(333): a, c, t, g, unknown or other
  misc_feature (333)..(333): n is a, c, g, or t
  modified_base (347)..(347): a, c, t, g, unknown or other
  misc_feature (347)..(347): n is a, c, g, or t
  modified_base (443)..(443): a, c, t, g, unknown or other
  misc_feature (443)..(443): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcagctggtggagtcgtgggggagcttggtccagccgtggggggtccctgagactctcctgtgcagcctctggatcaccttaggactattggatgagttggtccncaggctgcagggagggctgggagtgggtgccaantagagtgatggaanagaagaaatctatgtggactcgtgtggaagggccgattcaccatctccagagacaacgccaaagattcactgtatttacaaatgaacagcctgagngcgagcagtctgttatacttagtgtgacggaagggggcaaggtggcgtggggcttacgtcggggccgaaccgggg

SEQ ID NO: 312703 - DNA, 628 bp, Homo sapiens
  misc_feature: GZ8MTXP01B18AH.39.16.B05.1.454.CMB.2.raw
  modified_base (507)..(507): a, c, t, g, unknown or other
  misc_feature (507)..(507): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtgggtggagtcggtgggggagtcgttggtccaggcccggtggggggtccctggacgtacctctcctggtcgcacggtcctcgtggtaattccgtaaccgtttaagggtaacttagttggattggtaggtttcggggtcccgccgaggctggcggaagggggagggggctggggaggtgggggtacgaccaaagagtaggaaggtagagtaggaaagagaaagaaatgtatgtgactgtggaggaaggctatcacatcacagagacacgaccaagacttcacttgttaattaacaaatcgaaacngcctagagacgcggaacgacgagttctagttaatacttagtttacgggtaggaacggggttaaagggggctaaggggcggcggttcgggacgttacggtcgggggttcccgaacccggggg

SEQ ID NO: 312704 - DNA, 665 bp, Homo sapiens
  misc_feature: GZ8MTXP01C2ZBS.39.16.B05.1.454.CMB.2.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (306)..(306): a, c, t, g, unknown or other
  misc_feature (306)..(306): n is a, c, g, or t
  modified_base (379)..(379): a, c, t, g, unknown or other
  misc_feature (379)..(379): n is a, c, g, or t
  modified_base (539)..(539): a, c, t, g, unknown or other
  misc_feature (539)..(539): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggagcttggtccaggccgtggggggtccctgagactctcctgtncagcctntggatcacctttaggactattggatggagttgggtccncaggctgcgagggaagggggtctgggagtggggtggaccctaaagataggaggtagagtgggaaagagaaaanaaaatctaagtgtagggacttcgtaggtagggaacgggccgtaatttcaaccatcctacccgaagacgaaccaaacgacccaaagtaattacacttaggtttaaatttaaacaaaattgaaacaacgtccctagaaacgacggtacccggaaggtaaccnccggtaacttacggttaaatacgttaagtttgggagggttaaccgggggaaaggggggaccgtaagggtcgggggtgttacggggggaccttacggggtcgggggcccggtaaaacccccgggggg

SEQ ID NO: 312705 - DNA, 722 bp, Homo sapiens
  misc_feature: GZ8MTXP01DITFO.39.16.B05.1.454.CMB.2.raw
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtcagtgtgaggtgcagcgtggtggagtcgtgggggaggtcgttggtccaggccggtggggggtccctggacgtactctccgtgtcgcacgcctgtggatcctacctttaggaactattggatgaggttgggccnccgaggctgcgagggagggcgtgggaggtgggtgaccaaangtagaggtagagtaggaagagaaaagaaatcgtatggtagactcgtggtaggaacgggcgtattaccgacctatcctaccgaagacgtaaccaaaccggacccaaaagtaacttacgaacttagggtttaacttttaaacaaaagtacgtaaacacgtccgtaggaaacggacgaccccggaaaggaccctacggtaaccttagttaaacgttaaccgtttaggtttacgggtaacgggaaccggggggttaaaaacgggggggttcgtaaagggggttaccggggtaaccgggttcggggggtacccgttttaaccggggggtccccggggggttaacccggggtaaaacccccccgggggg

SEQ ID NO: 312706 - DNA, 648 bp, Homo sapiens
  misc_feature: GZ8MTXP01DXVIR.39.16.B05.1.454.CMB.2.raw
  modified_base (372)..(372): a, c, t, g, unknown or other
  misc_feature (372)..(372): n is a, c, g, or t
tcagtcgcactagtcacgaccggtgctcgatttagagctcacgtatttgggtttgggggcaggagtcagacccagtcaggacacagcgtggacatgagggtccccgctcagctcctggggctcctgctgctctggttcccaggttccagatgcgacatccagatgacccagtctccattcttccgtgtctgcatctgtaggagacagagtcaccatcacgttgtcgggcgagtcgagggtatagcagctggttagcctggtatcagacaagaaaccgagggaaacgacccctaagcctcctagatctagtgactgctatcctagtttcgacgtaaaggtcggggtaccccagtactaaggttcacgtcgacnggtggtatcgtagggactagtactttcacttcactacatcagacacgcctgacacgccgtaagtaacgttacgttttacgacttaaactttaacttattacgtactaaacgtaaggtaaccttaaccgttaccggtttacccggaacgggtaaccggtttcccgggaaacccgtaaacggggaaaccgtaaagggggtacgttaaaaacgttaccggaaaaaccggtaacgttagggtaaccggtacgcggttaactaaccccttaagtttaaccg

SEQ ID NO: 312707 - DNA, 710 bp, Homo sapiens
  misc_feature: GZ8MTXP01AV0JS.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggagtcgttggtccaggccggtggggggtccctgagtactctcctgtgcagcctcgtggatccaccgtttaggaacttagtggtatggtaggttcgggtccgcgaggctggcgagggggaggggctggggaggtgggtcgaccaaagagtaggaggtagagtagggaagagaaaagtaaatcgtaaagtggtagtacctgtagggtaggaaacggggtcccgtaattacccaaccgtattcccctaacgaacggaacgaaccgaaaccgaccccgaaaagtaactttacaaccgtttagggtttaaacttttaaccaaaattacggaaactacgtacccgtaggaacggaccgtaccggaacggtaacctacggtccttaagttaactacgttagttcgggtaacgggacggggttaaaaggggggcctaaggggtcggaacggttcggggaccgttaccgggtccgggggaacccgtaaacccccgggggg

SEQ ID NO: 312708 - DNA, 593 bp, Homo sapiens
  misc_feature: GZ8MTXP01AWNWP.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctgggtggagtcgtgggggaggtcttggtccaggccgtggggggtccctgagactctcctgtgcagcctctggatcactttaggactatggatgagttgggtccgcgaggctgcgaggggaggggctgggaggtggggtgaccaacgagtaggaggtagagtaggaagagaaagaaatctatggtggactcgtggtggaagggccgtattcaccatcctaccagacgacaacgaccaaagtaactacactaggttaatttaacaaattagaaaccacgacccgtagaacgacgccggaagaccacggtctagttataacgttagttggtaggacgggttaaagggggcaagggtggcgtggggtcgttacggtcggggccgaaccccggggg

SEQ ID NO: 312709 - DNA, 609 bp, Homo sapiens
  misc_feature: GZ8MTXP01CB9SB.39.16.B05.1.454.CMB.2.raw
  modified_base (184)..(184): a, c, t, g, unknown or other
  misc_feature (184)..(184): n is a, c, g, or t
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (513)..(513): a, c, t, g, unknown or other
  misc_feature (513)..(513): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtntccagtgtgaggtgcagcgtggtggagtcgtgggggagtcgttggtccaggccgtggggggtccctgagctctcctgtgcagcctntggatcaccttagactagttgatgagttggccncgagctgcgagggggagggcgtgggaggtggggtgaccaacagtaggagtaggatagggaagagaaagaaatcgtatgggtagactcgtaggtaggaaacgggtccgattccgaccatcctacccaagacaacaacgaccaaagaattcaacttaggttaaattaacaaattacgaaactagccgtagacgcgaccgaacgcgtaccgtntgttaatacttaaagtttgggacggaacggggaaagggggctaagggtcggcggttcgggaccgttacgggtcgggggaacccgtaaccccggggg

SEQ ID NO: 312710 - DNA, 613 bp, Homo sapiens
  misc_feature: GZ8MTXP01BQ0DT.39.16.B05.1.454.CMB.2.raw
  modified_base (372)..(372): a, c, t, g, unknown or other
  misc_feature (372)..(372): n is a, c, g, or t
  modified_base (541)..(541): a, c, t, g, unknown or other
  misc_feature (541)..(541): n is a, c, g, or t
  modified_base (545)..(545): a, c, t, g, unknown or other
  misc_feature (545)..(545): n is a, c, g, or t
  modified_base (575)..(575): a, c, t, g, unknown or other
  misc_feature (575)..(575): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggagcgttggtccaggccgtggggggtccctgacgactctcctgtgcacgcctcgtggtatcctacctttaggaacttagttggatggtaggttcggggtcccgccgaggctggcggaagggggaagggggcgtggggaggtggggtggaccaaanagtaggaggtaggagtagggaaagagaaaagaaatcgtatggtggacttcgtggtaggaacggggtccgtattaccaccactcctaccaggacgaaccaaccgaccaaagtaacttacacttaggttaatttaaacaaatacgaaacagccgtagagacgacgaggacncgtntgttatacttgtggtggagggaagggggcngggtggcgtgggcttacggtcggggccgtaacccgggg

SEQ ID NO: 312711 - DNA, 665 bp, Homo sapiens
  misc_feature: GZ8MTXP01B5LI5.39.16.B05.1.454.CMB.2.raw
  modified_base (349)..(349): a, c, t, g, unknown or other
  misc_feature (349)..(349): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcagctgggtggagtcgtggggggaggtcgttggtccaggccggtggggggtccctgagactctcctgtgcagcctctggatcacctttaggaactattggatgaggttggccgcaggctgcgaggggaggggctgggaggtgggtgaccaanagtaggaggtagagtgggaaagagaaaagaaataactagtggtggactcgtggtagggaacgggccgtattccgaaccactccgtccaagacgaacaaccgaccaaagtaacttacaacttacggtttaaatttaaacgtaaaactagaaaccgagtacccgtagaaacggacggacccggaaagacccgtacgttaaccgttaggttaacttaacgttaagtttcggtagggaacgggggttaaaacggggggcgtaagggtcgggtaacggttggggccgttacgggtcgggggaaccccgtaaccccgggggg

SEQ ID NO: 312712 - DNA, 625 bp, Homo sapiens
  misc_feature: GZ8MTXP01BRHFC.39.16.B05.1.454.CMB.2.raw
  modified_base (268)..(268): a, c, t, g, unknown or other
  misc_feature (268)..(268): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgtggttttcctgtgctatttagaaggtgtccagtgtgaggtgcagctgggtggagtcgtggggggaggcttggtccaggccgtgggggggtccctggagactctcctgtgcagcctntggatcacctttaggaactattggatggagttgggtcccgcaggctgcgagggggaacggggctgggagtggggtggaccaagagtaggaggtagagtagggaaagagaaagaaataactgtggtggactgtgtagaagggccgtattcactatcctaccgagacgaacaccgaccaaagtattactacgtaggttaactttaaacaaagtagaaacgtgaccgtgaacggacgacccggaaggtaccacgtcgtagttataacgttaagttcggttagggaacggggaaggggggttccgaagggttcgggccgttggggtaccgttacgggtcggggccccggtaaccccggggg

SEQ ID NO: 312713 - DNA, 634 bp, Homo sapiens
  misc_feature: GZ8MTXP01AGHAF.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgcggtgctagttggtggagtcgtgggggagcgttggtccagggccggggggtccctgagactctccgtgtgcagcctctggacttcccctttagagttatggctgagtcgtgggtccgcgaggcgtccgagggggaaggggttggaggtgggtgaccaaacgagtaaagcaaagagtagggaacgtacggaaagtagtatcgtaagggacttcggtagggtgggacgggggtccgttacaccgtatcctacagacgaacaacgaccaaagaacctcgtgacactcgtagaccaaatacggaaactaggtcctaggaacgacggaccggaggaaccgacggtccttagtttaactacgtcgacggcggaaggaaggaaggtcggttcggggttcgtttacgaacgttacggcgggaccgacgggacctcggttccgtaacccg

SEQ ID NO: 312714 - DNA, 717 bp, Homo sapiens
  misc_feature: GZ8MTXP01CDA42.39.16.B05.1.454.CMB.2.raw
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (324)..(324): a, c, t, g, unknown or other
  misc_feature (324)..(324): n is a, c, g, or t
  modified_base (376)..(376): a, c, t, g, unknown or other
  misc_feature (376)..(376): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggagcttggtccaggccgtgggggtccctgagtactctcctgtncagcctntgactcacttagactntggatgagtggccgcagctgcgaggggagggcgtagggnggtgggtcgaccgaaagtagtaggaggtagagtaggaaagagaaaagaaatntatggtgatcgtgtaggacggcgtatccacgtctacctaccaagacaaccaacgcaaagtaaacttcgaaactttagggttaaactttaaacgaaaacttacggaaaaccgtaacgtacccggtaagaaaccggggccgtaaacccggtaacgggtaaacctaacccgtttaacggttaaggtttaaccgtttaaacggttaacggtttaggggttacggggaaaaaaccggggggttaaaggggggttccgtaaagggggttccggtaaccgggggttcgggggtacccgtttaccgggggtaacccggggggttaaccccggggtaaaccccccggggg

SEQ ID NO: 312715 - DNA, 686 bp, Homo sapiens
  misc_feature: GZ8MTXP01APJMJ.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggagtcgttggccaggccggtggggggtccctggacgtactcctccgtgtcgcacgtcctgtggtactcctaaccgtttaaggaaccttagttggattggtaggttcgggtcccgccgaggctggacggagggggaaggggctgggaggtggggtacgaccaaagtagtaggaggtagagtaggaaagagaaaagtaaactaacgtatgggtagacttcgtaggtacggaaacgggtccctattccgaactactccgacgaagacgaaccaaccgaccgaaatacttacaacttaggttaaactttaaacaaagtacgaaacgtacgtcccgaaggaacgacgacccggaaggtacctacggttaactagttactaacgttagttggacggacggggttaaacgggggcctaaggggtcggtcggtacgggtaccgttacggggtccgggaacccggtaaccccgggg

SEQ ID NO: 312716 - DNA, 672 bp, Homo sapiens
  misc_feature: GZ8MTXP01AKXTS.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtccagtgtgaggtgcagcgtgggtggagtcgtgggggagtcgttggtccgaggtccggtcggggggtccctgacgtaccttctccgtgtcgcacgtccctgtggtacttaccgtaaccgtttaaggaacttagttggagtggtaggttcggtcccgcgaggcgtggacggaagggggaaggggcgtagggaggtggggtacgaccaagagtaggaggtagagtagggaaagagaaaaacgtaaatcgtagtgggtagacttcgtaggtacggaacgggcctagttccactacttaccacgaagaacaaccaaccggaccaaagtacttactacgttaggtttaaattaaacaaatacgaacctagcctaggacgagtacccggagacctagtctagttattacaggtttgaagggttaacggggaacggggttgaacggtgggcgtcggggaccttacgggtcgggggaaccccgtaaccccggggg

SEQ ID NO: 312717 - DNA, 551 bp, Homo sapiens
  misc_feature: GZ8MTXP02FOP3S.39.16.B05.1.454.CMB.2.raw
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (348)..(348): a, c, t, g, unknown or other
  misc_feature (348)..(348): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgtggtttccgtgttaggctatttagaaggtgtccagtgtgaggtgcagctggtggagtctgggggaggcttggtccagcctggggggtccctgagactctcctgtgcagcctngntcacttagactntgatgagtggcgcngcngcgagggaggngnggnggtggngcanagtagagagagaggagaaggaagtatntgtgagtgtgtaggagggacgtactactacactctcagagacaacgacaacgaactactactataattaactaaataagaacagacgagagacgacggacggacgacgtacgtacgtatactacgttagtacggtacgggaacggggacggtaggtggtcggtcggtacggtacggtacggggaccgggaccgggtaacccgg

SEQ ID NO: 312718 - DNA, 528 bp, Homo sapiens
  misc_feature: GZ8MTXP02FTJLY.39.16.B05.1.454.CMB.2.raw
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
  modified_base (381)..(381): a, c, t, g, unknown or other
  misc_feature (381)..(381): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttaggaactattggatgagttgggtccnccaggctgcaggggaggggctgggagtggggtggccaanatagaggtagatggaagagagaaatctatgtggactntgtgaagggcgattcacatctccagagacaacgccaaagattcactgtattacaaatgaacagcctgagagccgagacacgtctgtatactattgtgacggaagggggcaaggtggtgggctacgtggggccacggggtaaccccgg

SEQ ID NO: 312719 - DNA, 572 bp, Homo sapiens
  misc_feature: GZ8MTXP02FZ5Z8.39.16.B05.1.454.CMB.2.raw
  modified_base (448)..(448): a, c, t, g, unknown or other
  misc_feature (448)..(448): n is a, c, g, or t
  modified_base (506)..(506): a, c, t, g, unknown or other
  misc_feature (506)..(506): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttgggtccaggccgggggggtccctggagactctcctgtgcagcctctggacttcccctttacgagttattggctgagcgtgggtccgccaggctccgaggggaggggttggaggtgggtggccaaacataaagcaaagagtaggaagtaccggaaagagtatcgtggactcgtgtggagggggtccggttcaccatctccagacgacaacgccaaagaacctccgngacatctagacaaaatgaaacagtctagagagaccgagacacggtcttagttatacgngcgagagagaaggtcgtcgggtacgttcgacgtcggcggggaccgacgggacctcggcctaccgtc

SEQ ID NO: 312720 - DNA, 594 bp, Homo sapiens
  misc_feature: GZ8MTXP02GMU4W.39.16.B05.1.454.CMB.2.raw
  modified_base (281)..(281): a, c, t, g, unknown or other
  misc_feature (281)..(281): n is a, c, g, or t
  modified_base (349)..(349): a, c, t, g, unknown or other
  misc_feature (349)..(349): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtaggcgtatttagaaggtgtccagtgtgcggtgcagttggtggagtctgggggagcttggtccaggccggggggtccctgagctctcctgtgcagcctctggattcccctttagagttnttggctgacgctggtccgccaggcgtccgagggaaggggttggaggtgggtggccgaacgataaaganaagagtggaacgtaggaaagagtatacgtggacgtcgtgtggaggggccgttcgacatctccagagacaacgacaagaacgtccgngcatcnganaatagacagtgagagacgacggacggacgacggtacgttagttagttacgtacgtcgacggacggaaggaacggtacggtacggggttacgggttacggtaacgtacggtacggggaccggtaccgggtaaccggtacggtaccgtaccg

SEQ ID NO: 312721 - DNA, 538 bp, Homo sapiens
  misc_feature: GZ8MTXP02GF82I.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttaggaactattggatgagttggtccgccaggctgcgagggaggggctgggagtgggtggccaagatagaggtagatggaaagagaagaaatctatgtggactcgtgtgaagggccgattcacatctccagacgacaacgaccaaagattacactagtatttacaaatagaacagctagagagccgagacacgtctagtatactattgtgacggaaagggggcaaggtggacgtgggctacggtcggggaccgaaccggggg

SEQ ID NO: 312722 - DNA, 587 bp, Homo sapiens
  misc_feature: GZ8MTXP02FXKQ1.39.16.B05.1.454.CMB.2.raw
  modified_base (348)..(348): a, c, t, g, unknown or other
  misc_feature (348)..(348): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttaggaactagttggatgagttgggtccgcgaggctgcgaggggaggggctgggaggtggggtcgaccgaanagtaggaggtagagtggaagagaagaaatctagtgtggactgtggtaggaaagggccgtattccgaccatcctaccagacgacaacgaccaaagattacactagttaatttaacaaatagaacacgcctaggacgacggccgaaggaccaacgtcgtagtattacttaagttgtacggtaacgggaagggggctaagggtcggcgtcggggctacggtcgggggaccgtaaacccgggg

SEQ ID NO: 312723 - DNA, 524 bp, Homo sapiens
  misc_feature: GZ8MTXP02JYV3U.39.16.B05.1.454.CMB.2.raw
  modified_base (379)..(379): a, c, t, g, unknown or other
  misc_feature (379)..(379): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttaggaactattggatgagttgggtccgccaggctgcaggggaaggggctgggagtgggtggccaacatagaggtagatggaagagagaaatctatgtggactntgtgaaagggccgattcaccatctccagagacaacgccaaagaatcactgtatttacaaatgaacagcctgagagccgaggacacgtctagatactaattgtgcgaaaagggggcaagtggctgggctacgtggggcaaccgggg

SEQ ID NO: 312724 - DNA, 519 bp, Homo sapiens
  misc_feature: GZ8MTXP02GAXSV.39.16.B05.1.454.CMB.2.raw
  modified_base (379)..(379): a, c, t, g, unknown or other
  misc_feature (379)..(379): n is a, c, g, or t
  modified_base (398)..(398): a, c, t, g, unknown or other
  misc_feature (398)..(398): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgtggtttcctgtgctatttagaaggtgtccagtgtgaggtgcagctggtggagtcgtgggggaggcttgggtccagccgtggggggtccctgagactctcctgtgcagcctctggattcaccttcagtagctatagcatgaactgggtccgcaggctcgaggggaaggggctggagtgggtctcatccccattagtcgtagtagtagttacatatactacgcagactnagtgaaggccatcacatcncagacacaacgccaaagaactcaagtntatctanacaananaacacgacagagacgacgacggacgacgcgtagtagtactagtagtgcgtagttacggttttggtttggttacgtcgtcg

SEQ ID NO: 312725 - DNA, 541 bp, Homo sapiens
  misc_feature: GZ8MTXP02IZDSE.39.16.B05.1.454.CMB.2.raw
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccaggcctgggggtccctgagactctcctgtgcagcctctggattcacctttacgagttattggctgagctgggtccgcaggctccgagggaaggggttggagtgggtgccaacataaagcaagatggaagtcggaaaagagtaatcgtggactcgtgtggaggggccgttcaccgatctccagagacaacgccaaagactccgngcatctgacaaatgaacagtcngagagccgaggacacggcttaggtttatactgcgacgagagaaggactggggcggtttcgacgtacgtcgggggaccagggtaaccccg

SEQ ID NO: 312726 - DNA, 640 bp, Homo sapiens
  misc_feature: GZ8MTXP02JJ4XW.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctcgtggattcctacttaggaactattggatgaggttgggtccgcgaggctgcgagggaaggggctgggaggtgggtcggccaacgataggaggtagagtaggaagagaagaaatacgtaatggtggactcgtaggtaggaaacggggccgtattaccgacctaatcctacccgagacgaacaaccgaccaaagtaacttacacttaggttaactttaacaaaagttacgaaacgtacgaccgtaggaacggacgaccggaaggaccacggtaccgtagttactaacgttaagttcggtagggtaaccggggaaaagggggccaagggtgggtacgtacggggaccgtacggtcgggggacccgtaaaccccggggg

SEQ ID NO: 312727 - DNA, 551 bp, Homo sapiens
  misc_feature: GZ8MTXP02IQUD6.39.16.B05.1.454.CMB.2.raw
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtgggggtccctgagactctcctgtgcagcctctggattcaccttaggaactattggatgagttgggtccnccagctgcagggaagggctggagtgggtgccaanagtagaggtagatggaagagaagaaatctatgtaggactcgtgtaggaacgggccgattcaccgatctcccagagaacaacgaccaaagaattacactagtaatttaacaaatgaaactagacctagagacgccgagtacgaacgtctgtatactattcgtagacggaaagggggcaaggtggacgtgggactacggtcggggaccgaaccgggg

SEQ ID NO: 312728 - DNA, 567 bp, Homo sapiens
  misc_feature: GZ8MTXP02JEYMC.39.16.B05.1.454.CMB.2.raw
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagctctcctgtgcagcctctggattcacctttaggactntggatgagttgggtccncaggctgcgaggggagggctgggagtgggtgaccaanataggaggtagagtaggaaagagaagaaatcgtatggtggacctgtggtaggaagggccgtattccacctatctaccagacgaacaacgaccaaagtattcacttagtaacttaacaaatacgaaacacgcctagacgacgccgaagacacgtctagtatactattcggagacgggaaagggggcaagggtcggcgtcgggacgtacggtcggggacccgaacccggggg

SEQ ID NO: 312729 - DNA, 570 bp, Homo sapiens
  misc_feature: GZ8MTXP02I1USF.39.16.B05.1.454.CMB.2.raw
  modified_base (472)..(472): a, c, t, g, unknown or other
  misc_feature (472)..(472): n is a, c, g, or t
  modified_base (527)..(527): a, c, t, g, unknown or other
  misc_feature (527)..(527): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttaggaactattggatgagttggtccgcaggctgcgaggggaggggcgtgggaggtggggtggaccaacgagtaggaggtagagtaggaagagaagaaatctatggtgactcgtgtaggagggccgtagttcaccatctacccgagacgaacaacgaccaaagacttacacttagtaatttaacaaatacgaaacngaccgtagagacgccgagacacgtctagtatactattggtgacgggaacgggggnaaggtggcgtcggggactacggtcggggaccgtaacccggggg

SEQ ID NO: 312730 - DNA, 542 bp, Homo sapiens
  misc_feature: GZ8MTXP02IFATN.39.16.B05.1.454.CMB.2.raw
  modified_base (410)..(410): a, c, t, g, unknown or other
  misc_feature (410)..(410): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtgggggtccctgagactctcctgtgcagcctctggattcacctttaggaactattggatgagttgggtccgccaggctgcaggggaaggggctgggagtgggtggaccaacgatagaggtagatggaagagaagaaatctatgtggactcgtgtgaagggccgatcaccatctcaganacaacgccaaagatcaactgttaatttacaaatagaacagacctgagacgccgaggacacgtctagtatactagttgtcgacggaagggggcaaggtggcgtcggggctacggtggggacctaacccggggg

SEQ ID NO: 312731 - DNA, 588 bp, Homo sapiens
  misc_feature: GZ8MTXP02GUJO5.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcaccttaggaactattggatgagttgggtccgccgaggctgcgaggggaaggggctggggaggtggggtggaccaaacgataggaggtagagtaggaagagagaaaatcgtatgtggactctggtgaacgggccgattcaccatctaccagacgaacaaacgaccaaagaacttacacttagtaatttaacaaaattggaaacacgacctaggaagacgacccggaaggacaacggtctagtaatactattggtagacgggaaagggggcaaggtcggacgtggggacctacggtcgggggaccgaaacccggggg

SEQ ID NO: 312732 - DNA, 561 bp, Homo sapiens
  misc_feature: GZ8MTXP02GHB0R.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattcaccttaggaactattggatgagttggtccgcaggctgcgaggggaaggggctgggagtggggtcgaccaacagtagaggtagataggaagagagaaatctatgtaggactctggtggaacgggccgattccgaccatctaccagacgacaacgccaaagtatacactagttatttaacaatagaacagcctagagagccgagacacgtctagtatactagttgtacggacggtaagggggcaaggtggacggtcgggacgttacggcgggggaccgtaacccggggg

SEQ ID NO: 312733 - DNA, 692 bp, Homo sapiens
  misc_feature: GZ8MTXP02HNUXI.39.16.B05.1.454.CMB.2.raw
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccaggccgtggggggtccctggagactctcctgtgcagcctctggattcacctttaggaactattggatgagttgggtccgccgaggctgcgaggggaagggctgggagtgggngaccaanagtaggaggtagagtagggaaagagaagaaaatacgtaagtggtaggactcgtaggtagggaaacggggcccgtaattacccaacctatccctacccgaaaggaacgaaaccgaaaccgaacccgaaaagtaaacttacgaaactttagttaaattttaaacaaaagttaggaaaaccaggtacccaggaaggaacgaccggaacggaacctaaaccggttacgttaacgttaaattaaacgttaggttacggacgggaaacgggggtaaaagggggacgtaaggggtcgggtacggtacggggtaccgttaccggggtaccgggggaacccggtaacccgggg

SEQ ID NO: 312734 - DNA, 620 bp, Homo sapiens
  misc_feature: GZ8MTXP02F3YNA.39.16.B05.1.454.CMB.2.raw
  modified_base (305)..(305): a, c, t, g, unknown or other
  misc_feature (305)..(305): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattcaccttaggaactattggatgagttgggtccncgaggctgcgagggagggctgggagtggggtgaccaagagtaggaggtagagtaggaaagagaagaaatacgtagtggtaggacttcgtaggtagggaacggggtacccgtattaccaaccctatacccgtacccgagacgaaccgaaaccgaccaaaagtacttacacttagttaattaacaaaataggaaacaacgcctagacgacgaccgaaggaccgacgtactagttataacgttagttaggtacggacgggaaagggggtcaagggtcggacggtcgggacgtacggtcgggggaccgtaacccggggg

SEQ ID NO: 312735 - DNA, 631 bp, Homo sapiens
  misc_feature: GZ8MTXP02JWK5H.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggaggcttggtccagccgtggggggtccctgagactctcctgtgcagccctctggattccaccgtttaggaacttagttggatggaggtttgggtcccgccgaggctggacggaaggggaaggggcgtaggggaggtggggtcggaccaaacgagtaggacggtagagtagggaaagaggaaagaaatacgtaagtggtaggacctgtggtaggaaagggtccgtattaccacccgtattccacccgagacgaacaacgaccaaagtaacttacacttagttaactttaacaaaagtgaaacgcgaccgtaggacgacgaccggacgacacgttctagtatacgtatggtaggaccgggtaaaggggcgaaggtcggacgtcggggtactacgggtcgggaccgtaacccggggg

SEQ ID NO: 312736 - DNA, 672 bp, Homo sapiens
  misc_feature: GZ8MTXP02FGJQY.39.16.B05.1.454.CMB.2.raw
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (367)..(367): a, c, t, g, unknown or other
  misc_feature (367)..(367): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtcctgngactctctcgtgcagcnctggatctaccttacggtaactattggtagtgaggttgggttccggccgacggcgtgcgaggggaaggggacgtgggaggtgggtgggcgacatagaggtagganaggaagagagaaatactatagtggtacgtacttgtaggaaggggacccgtaatttccaacccgaattccgtaccccgaagaacgaacaaaacccgccgaaaacgtaaactttacctacctaggtttatttaaaaccaaaacttaagggaaccaacgtccgtagaaggacggacccggtagggaaacacccggtacttagtaagttaaccttaagttggtcggaacgggggaaaacgggggggacctaaggtggggtcgttacgggggacgtaaccgtcgggggggaccccgaaaaccccgggggg

SEQ ID NO: 312737 - DNA, 597 bp, Homo sapiens
  misc_feature: GZ8MTXP02H0FKP.39.16.B05.1.454.CMB.2.raw
  modified_base (343)..(343): a, c, t, g, unknown or other
  misc_feature (343)..(343): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgagtgcagcgtggtggagtcgtgggggaggcttggtccagccgtggggggtccctgagactctcctgtgcagcctctggattcacctttaggaactattggatgagtttgggtcccgccgaggctggcgaggggaaggggctgggagtgggnggaccaagagtaggaggtagagtaggaagagaagaaatctagtgtagacttctggtaggaacggggccattcgacccatcctaccagacgacaaccgaccaaagtaacttcaactgttaatttaacaaaattagaaacagacctagaaggacgaccggaagggaaccacgttcagttaatacttaagttcggtagacgggaaagggggcaaggtcggcgtacgggacttacgggcggggaccgtaacccggggg

SEQ ID NO: 312738 - DNA, 569 bp, Homo sapiens
  misc_feature: GZ8MTXP02IWXX4.39.16.B05.1.454.CMB.2.raw
  modified_base (534)..(534): a, c, t, g, unknown or other
  misc_feature (534)..(534): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattcaccttaggaactattggatgagttgggtccgcgaggctgcgaggggaaggggctgggaggtggggtggaccaacgagtaggagggtagatgggaaagagaagaaatctagtggtggactctgtagagggcgattcacatctccagacgacaacgaccaaagaacttacacttagtaactttaacaaaatagaaacagacctagaacggacgaccggagacacgtactagtatactattcgtcgacggaagggggcaaggnggcgtcggggctacggtcggggaccgaaccggggg

SEQ ID NO: 312739 - DNA, 705 bp, Homo sapiens
  misc_feature: GZ8MTXP02IZCVM.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctgggtggagtcgtgggggagtcgttggtccaggccggtggggggtccctggacgtctctccgtgtcgcagcctcgtggtacttacctaccgtttaggaacttagttaggatggtaggtttcggggtcccgccgaggtccgtggaccggaagggggaacggggcgtaggggtaggtcggggtacgaccaaagagtaaggaggtagagtagggaaaggagaaacgtaaatacgtagttaggtaggtaaccttgtagggtacggaaacgggggtaccctattaccgaaccctatacccgtaccgaaagaacgaaaccaaccgaaccaaaagtactttaccgaactttagttaaaactttaacaaaagttacggaaacaagccgaagacggacgcccggtaaagcctaacggttctagttactacttaggtcggacggggaacggggaagggtcgaagggtcggacggtacgggaccgtacggggaccggggacccggtaaccgggg

SEQ ID NO: 312740 - DNA, 587 bp, Homo sapiens
  misc_feature: GZ8MTXP02J5OGN.39.16.B05.1.454.CMB.2.raw
  modified_base (237)..(237): a, c, t, g, unknown or other
  misc_feature (237)..(237): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
  modified_base (521)..(521): a, c, t, g, unknown or other
  misc_feature (521)..(521): n is a, c, g, or t
  modified_base (531)..(531): a, c, t, g, unknown or other
  misc_feature (531)..(531): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggtttcctgttgctatttagagtgtccagtgtgagtgcagctggtggagtcgtgggtagctggtccagccgtggggttcccgtnagactctcctgtgcagcctctggattcaccgttaggaactattggatcgtaggtggtcccggaccagcgtgcgagggtaagggtcgtagggtggtaggttcgggacgaccaataggtaacggagtagtaggaggagaacggaatctaactgtggtactcgtctggggaactcggggacttacgaccactactacccgacgaacgacaaacgaccaacgttaactcaaacttcgtattacgtacaaggtacngacangaaacgggcncggttaggactcgacgtntacggtactntacgtacgtggacggtaaggacgtagggtcagggggttccagggtctttccggggg

SEQ ID NO: 312741 - DNA, 600 bp, Homo sapiens
  misc_feature: GZ8MTXP02GIQKI.39.16.B05.1.454.CMB.2.raw
  modified_base (264)..(264): a, c, t, g, unknown or other
  misc_feature (264)..(264): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagctctcctgtgcagcctntggattcaccttaggaactattggatgagttgggtccgccaggctgcgagggaggggctgggagtgggngaccaanagtaggaggtagagtaggaagagaagaaatcgtatggtggactcgtaggtaggaaacggggccgtattccgacctatcctaccgagacgaacaaccgaccaaagtaacttacaccttagttaactttaaacaaaagttagaaacacgaccgttagaacgacggaccgaagggaccacggtctagttatacttagttgtacgacgggaaagggggcaaggtcggacgtcggggacgtacggtcggggaccgtaacccgggg

SEQ ID NO: 312742 - DNA, 571 bp, Homo sapiens
  misc_feature: GZ8MTXP02FO434.39.16.B05.1.454.CMB.2.raw
  modified_base (349)..(349): a, c, t, g, unknown or other
  misc_feature (349)..(349): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccaggccgtggggggtccctggagactctcctgtgcagcctctggattcacctttaggaactattggatgagttgggtccgccaggctgcgaggggaggggctgggaggtggggtggccaanagtagaggtagataggaagagaagaaatacgtatggtggacttcgtggtaggaaggggccgtagttccacctactcctacccgagacgaacaaccgaccaaagaattacactagttaatttaacaaatagaacagcctagagacgcgagacacgtctagtatactattgtggacgggaagggggcaaggtggcgtgggcgtacggtcgggccgtaaccgggg

SEQ ID NO: 312743 - DNA, 639 bp, Homo sapiens
  misc_feature: GZ8MTXP02I29GA.39.16.B05.1.454.CMB.2.raw
  modified_base (270)..(270): a, c, t, g, unknown or other
  misc_feature (270)..(270): n is a, c, g, or t
  modified_base (309)..(309): a, c, t, g, unknown or other
  misc_feature (309)..(309): n is a, c, g, or t
  modified_base (347)..(347): a, c, t, g, unknown or other
  misc_feature (347)..(347): n is a, c, g, or t
  modified_base (583)..(583): a, c, t, g, unknown or other
  misc_feature (583)..(583): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggagtcttggtccaggccgtggggggtccctggacgactctcctgtgcagcctntggattcacctttaggaactagttggatgagttgggccncgaggctgcgaggggaagggctgggagtgggtgccaanagtaggaggtagagtaggaagtagaacgaaatctagtggtaggactcgtggtacggacggggacccgtattaccgacctatacctacaaggaacgaacgaaaccgaccaaagtaattaccaactttacgttaatttaaacgaaaatacgaaaacagtccgtaggacgacggaccgaggaacctacggtacgtaggttaaatacttagttacggtaggacggggtaaaacggggggngtaagggtcgggtacggtacggtacggtacggggaccgggtacccggtaaccgggg

SEQ ID NO: 312744 - DNA, 651 bp, Homo sapiens
  misc_feature: GZ8MTXP02HMA00.39.16.B05.1.454.CMB.2.raw
  modified_base (266)..(266): a, c, t, g, unknown or other
  misc_feature (266)..(266): n is a, c, g, or t
  modified_base (307)..(307): a, c, t, g, unknown or other
  misc_feature (307)..(307): n is a, c, g, or t
  modified_base (486)..(486): a, c, t, g, unknown or other
  misc_feature (486)..(486): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggaggcttggtccagccgtgggggtccctgagactctcctgtgcagcctntgattcaccgttaggaactagtggatgtaggttcgggtccncgaggctggacggaggggaaggggctgggaggtggggtcgaccaagagtaggaggtagagtagggaaagagaagaaaatcgtaagtggtggtacctgtggaggacgggcgtatccaccatctaccgaagacgaaccaaacgaccaaaagtaacttactacgttagtttaaacttttaanaaaacttaggaaaccacgtaccgtaggaacggaacggcccggaaagaccgtacggttactaggttaatacgttagtttagggacgggtaacgggggaaagggggtactaaggggtcggacggttcggggacgtaccgggtacgggggaccccgtaaacccggggg

SEQ ID NO: 312745 - DNA, 697 bp, Homo sapiens
  misc_feature: GZ8MTXP02IZ89C.39.16.B05.1.454.CMB.2.raw
  modified_base (331)..(331): a, c, t, g, unknown or other
  misc_feature (331)..(331): n is a, c, g, or t
tcagtcgcactagtcacgaccggtgctcgatttagagctcacgtattgggtttgaggtctcagaaaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcgttggtccagccgtgggggtccctgagactctcctgtgcagcctctgattcacttagactatgatgagttggtccgcagctgcgaggagggctggaggtggtgccaaacngtaggaggtagatagggaagagaagaaatactagtggtaggtactcgtggtaggaacggggtccaattccgaacccagtcctacccgaagtaacggaaccaaaccggacccaaaaggtaaacttaccgaaaccgtttagtttaaacgtttaaacctaaaagttacggaaaacctacgtacccgtagggaacggacggaaccgggaagggtaaccctaaacgtccgtttaggtaaacttaaccgttaggtttacggtacgggtaaaccgggggaaaaggggggtccaaggggtcgggaccggttacgggggttacccgtaaacggggtcccgggggaacccgggaaccgggggttaacccccccggg

SEQ ID NO: 312746 - DNA, 585 bp, Homo sapiens
  misc_feature: GZ8MTXP02FZDI3.39.16.B05.1.454.CMB.2.raw
  modified_base (343)..(343): a, c, t, g, unknown or other
  misc_feature (343)..(343): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtgggggtccctgagactctcctgtgcagcctctggattcacctttaggaactattggatgagttgggtccgccaggctgcgaggggaaggggctgggagtgggtgaccaanagtagaggtagagtgggaaagagaagaaaatcgtatggtggaactcgtaggtggaaagggccgtaattccaaccatcctacccgaagacggaaacaaaccgccaaaagaaactttccaaccgttataaacttttaaacaaaattagaaactacgcctagaagacgccgaaggacacgtctgtaatacgtattgtgacggaagggggcaaggtggacgtggctacgtcgggccgtaaccgggg

SEQ ID NO: 312747 - DNA, 612 bp, Homo sapiens
  misc_feature: GZ8MTXP02IPD3D.39.16.B05.1.454.CMB.2.raw
  modified_base (485)..(485): a, c, t, g, unknown or other
  misc_feature (485)..(485): n is a, c, g, or t
  modified_base (496)..(496): a, c, t, g, unknown or other
  misc_feature (496)..(496): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcgttggtccaggccggtggggggtccctgagactctcctgtgcagcctctggattctactttaggaacttattggatggtaggtttcgggtccgccgaggcgtggacggaaggggaaggggcgtggggaggttggggtacggaccgaacgagtaggaggtagagtaggaagagaagaaatgtatgtgactcgtggtaggaacgggtcgattccacctatctaccagacgacaaacgaccaaagacttcaacttagttaacttanaaaatgaaacngcctagagacgcgaaggacacgttctagttaatacttagttcggtacgggaaccggggtaaagggggctaaggtcgggcgttcggggactcgggtacgggggaccgaaacccgggg

SEQ ID NO: 312748 - DNA, 630 bp, Homo sapiens
  misc_feature: GZ8MTXP02I78N2.39.16.B05.1.454.CMB.2.raw
  modified_base (376)..(376): a, c, t, g, unknown or other
  misc_feature (376)..(376): n is a, c, g, or t
  modified_base (395)..(395): a, c, t, g, unknown or other
  misc_feature (395)..(395): n is a, c, g, or t
  modified_base (576)..(576): a, c, t, g, unknown or other
  misc_feature (576)..(576): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgaacttgggttttccttgttgcttattttagaaggtgtccagtgtgaggtgcagcgtggtggagtcggtgggggaggtcgttgggtccaggtcccggttggggggtccctggagtacctctcctggtgcagccctctggacttctacctttaggaactattggatggtagttcggtccgccaggctggacgaaggggagggctggagtggatggaccagatagaggtanagtaggaagagaagaaatntaagtggtacgactcgtggtaggaaacggggtcctattaccaccgtatcctaccgaagacgaaccaacgacctaaaagacttaccaattagttaaatttaaacaaaagtgaaaactcgctagaagacgacgaggaccacgttctagtactaacgttgttacgaggaacggggaaagggggntaagggtcggtcggttacgggccgttacgggcgggggaccccgtaaacccgggg

SEQ ID NO: 312749 - DNA, 593 bp, Homo sapiens
  misc_feature: GZ8MTXP02GTXE7.39.16.B05.1.454.CMB.2.raw
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (308)..(308): a, c, t, g, unknown or other
  misc_feature (308)..(308): n is a, c, g, or t
  modified_base (349)..(349): a, c, t, g, unknown or other
  misc_feature (349)..(349): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtagctatttagaaggtgtcagtgtgaggtgcagngtggtggagtcggtgggggagtcgttggtccaggtccgtgggggtccctgacgtctctcgtgtgcncgcctnggtactactacgttaggactagttgatgtaggtcggtccncgtagctgacggaggggaggcgtagggaggtggcgaccaanagtagagtagagtaggaagaagaagaatagtagtcggtagtactgtagaggaacgggcctaatccgaactagtacgacccgaaagcgaaaccacgttaacaaatactcgattaagtactaaaananananacgacgagagacgacgacgacgtacgtacgtagtatacgttagtacggtacggaacgggaagggaggtaacggtacggtacggtacggtacggtacggaccggaccggaaccgg

SEQ ID NO: 312750 - DNA, 614 bp, Homo sapiens
  misc_feature: GZ8MTXP02I0J4Y.39.16.B05.1.454.CMB.2.raw
  modified_base (345)..(345): a, c, t, g, unknown or other
  misc_feature (345)..(345): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacttaggactattggatgagttgggtccgcgaggctggcgaggggaaggggctgggaggtgggtacgaccaanagtaggaggtagagtaggaagagaagaaatctagtggtaggactcgtaggtaggaacggggccgattccgacctatcctaccagacgaacaaccgaccaaagtaacttcacttagttaatttaacaaatcgaaacagcctagagacgcgaagactacgtctagtaactacgttaagttggtacggaacgggggtaaagggggcctaaggggtcgggtacggttacgggggaccgttaacggggtcgggggaaccccgtaaacccggggg

SEQ ID NO: 312751 - DNA, 546 bp, Homo sapiens
  misc_feature: GZ8MTXP02GYT2U.39.16.B05.1.454.CMB.2.raw
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctatttagaaggtgtccagtgtgaggtgcagctggtggagtcgtgggggagcttggtccagccgtgggggtccctgagactctcctgtgcagcctctggattcacctttaggaactattggatgagttgggccnccaggctgcgagggaagggctgggagtggggtgaccaaanagtaggacggtanagtggaaagagaagaaatatangtggactcgtgngaagggcgatcacatctccagagacaaacgaccaaagaatacatagtattaacaaatanaanagcctagagagccgaagacacgtctagtatactaattgtagacggaaagggggacgaaggtggactggggacgtacgacgggggaccgaacccgggg

SEQ ID NO: 312752 - DNA, 701 bp, Homo sapiens
  misc_feature: GZ8MTXP02I5QTR.39.16.B05.1.454.CMB.2.raw
  modified_base (264)..(264): a, c, t, g, unknown or other
  misc_feature (264)..(264): n is a, c, g, or t
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcagctggtggagtcgtgggggagcttggtccagccgtggggggtccctgagactctcctgtgcagcctntggattcaccttaggaacttagttggatggagttgggtccnccgaggctgcgaggggaaggggctgggagtgggtggaccaanagtagaggtagagtggaagagagaaatcgtatggtggactcgtgtaggagggtcccgattccgaacctagtcctaccgaagacggaacaaacgaccaaagtaaacttacaaccgttagttaaactttaaacgaaaactttaggaaaaccgaggtacccgttagggaacggtaaacgggccccggaaacgggtaaccgaacggttaccgttaggttaaactttaaccgtttaaaagttcgggttacggggaaaaccgggggaaaacggggggggtgtaaaccgggggttggggtacgggtacgggggtaccgtttaaacggggtcccgggggggaccgtaaaacccccggggggg

SEQ ID NO: 312753 - DNA, 675 bp, Homo sapiens
  misc_feature: GZ8MTXP02G1YZ2.39.16.B05.1.454.CMB.2.raw
  modified_base (354)..(354): a, c, t, g, unknown or other
  misc_feature (354)..(354): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccaggccgtgggggtccctgagctctcctgtgcagcctcgtggtattcctaccgtttaggaacttagttggatggaggtttgggccgcgaggctggcgaggggaagggctgggaggtgggtcgaccaanagtagaggtagagtaggaagagaagtaaatcgtaagtggtaggacttcgtaggtaggaaacggggtcccgtaattacccgaactacgttacctacccgaaggaacgaaccaaacggaacccaaagtaaacttacgaaacttagttaactttaacaaaattacgaaacacgacctaggaagacggacccggaaggacctacggtacttagtaaacttaccgttagttaggtacgggaagggggtaaaacgggggctaaggggtcggtcggttacgggggtacctttaccggggtccgggggacccggtaaacccccgggggg

SEQ ID NO: 312754 - DNA, 540 bp, Homo sapiens
  misc_feature: GZ8MTXP02H86K0.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttgggtccagcctggggggtccctgagactctcctgtgcagcctctggattcacctttaggaactattggatgagttgggtccgcaggctgcaggggaaggggctgggagtgggtgccaacatagaggtagatggaaagagagaaatctatggtgggactctgtgaagggccgattcaccatctccagagacaacgaccaagaattacactgtaatttacaaatgaaacagacctgagagccgaggacacgtctgtatactattgtgacggaagggggcaaggtggacgtcgggactacggtgggggaccgaaccggggg

SEQ ID NO: 312755 - DNA, 615 bp, Homo sapiens
  misc_feature: GZ8MTXP02JRVZU.39.16.B05.1.454.CMB.2.raw
  modified_base (312)..(312): a, c, t, g, unknown or other
  misc_feature (312)..(312): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccaggccgtggggggtccctgagactctcctgtgcagcctctggattctacctttaggaacttagttggatggtagttgggtccnccgaggctgcgaggggaaggggctgggaggtgggtcggaccaacagtaggaggtagagtaggaaagagaaagaaactactagtggtaggacttcgtaggtaggaaacggggccctaagttaccacctatcctaccgagacgaacaacgaccaaagtaacttcaacttagtaaactttaacaaatacgaaacagcccgtaggacgacgaccgaaggactacgtctagtaattactagttgacggaacggggaaagggggcaaggtcggcggtgggacgtacggtcgggggacctaaaccggggg

SEQ ID NO: 312756 - DNA, 695 bp, Homo sapiens
  misc_feature: GZ8MTXP02JDXP5.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggaggtcgttggtccgaggtccggtcggggggtccctggacgactccgtcctgtcgcacgcctcgtggattactacctttaggaactattaggatggtacgttcgggtccgccgaggcgtgacgaggggaggggctagggaggtgggtcgaccgaacagtagaggtagagaggttaagagaagaaactagtagtagtaggtactgtgtaggaacgggtccgtacttaccgaccactcctaccgaagacgaacgaaccgacaaacgtaacttactaacgttagttaaacttaaccgtaaaagttacgaaacaacgacctaggaacgacggaccggaagaccgacgttacctagttaaccttaacgtagttacggtacgggtaaccgggggtaaaagggggaccggtaagggtacggtaccggggttacgggtacggtaacccggggttaccgggggacccgggttaaaaccccccggggg

SEQ ID NO: 312757 - DNA, 681 bp, Homo sapiens
  misc_feature: GZ8MTXP02JP970.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggaggtcttggtccagccgtgggggtccctgagactctcctgtgcagcctcgtggacttctacctttaggaaccttagttaggatggtaggtttggggtcccgccgaggctgcgaggggaaggggcgtgggaggtggggtcggaccaagagtaggaaggtagagtaggaaagagaagaaatcgtagtggtaggactcgtaggtggaaacggggtccgattacccgaccacgtcctccgaagacgaaccgaaaccgaccaaaagtaacttacacttagttaatttaaaccaaattagaaaccagtacccgtagaacgacgacccggaagaccgaacggttacgtaggttaaattaccgttaagtttcggtacggtaaccgggggaaaacgggggtcgaaggggttacgggtcggttacgggggtaccgttaacgggtccgggggacccggtaaaacccccggggg

SEQ ID NO: 312758 - DNA, 759 bp, Homo sapiens
  misc_feature: GZ8MTXP02HUWBM.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaagtgtccagtgtgagtgcagctggtggagtcggtgggggagtcgttggtccagccgtgggggtccctggacgtactcctccgtgtgcacgccctgtggtacttacctaaccgtttaaggaacttgttaggattgtaggtttcgggtccgccgaggtccgtggacggaaggggaacggggcgtggggagggttggggtcgaaccgaaacgaagttaggaagggtaagagtagggaaagaagaagaaaacttagtagtagtaggtaccgttcgtaggtagggaacgggtaccgtacttacccgaaccgtaacttccacccgaaggaaccgaaaccgtaaacccgaacccaaaaggtaaaccttacctaaacttaagttaaacttttaaaacgaaaatttacgaaaccgacgttaacccgaggacggaccggaccggaacgaaccgtaaccgtacgttagttaacgttaaacttacggttaggtacgggaaacgggggtaaaagggggtcgtaaacggggttcggtcggggtttaccggggacgttaaccggggtaccgggggaacccgtaaacccccgggggg

SEQ ID NO: 312759 - DNA, 586 bp, Homo sapiens
  misc_feature: GZ8MTXP02J4Y6A.39.16.B05.1.454.CMB.2.raw
  modified_base (296)..(296): a, c, t, g, unknown or other
  misc_feature (296)..(296): n is a, c, g, or t
  modified_base (367)..(367): a, c, t, g, unknown or other
  misc_feature (367)..(367): n is a, c, g, or t
  modified_base (451)..(451): a, c, t, g, unknown or other
  misc_feature (451)..(451): n is a, c, g, or t
  modified_base (466)..(466): a, c, t, g, unknown or other
  misc_feature (466)..(466): n is a, c, g, or t
  modified_base (476)..(476): a, c, t, g, unknown or other
  misc_feature (476)..(476): n is a, c, g, or t
  modified_base (490)..(490): a, c, t, g, unknown or other
  misc_feature (490)..(490): n is a, c, g, or t
  modified_base (499)..(499): a, c, t, g, unknown or other
  misc_feature (499)..(499): n is a, c, g, or t
  modified_base (520)..(520): a, c, t, g, unknown or other
  misc_feature (520)..(520): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggagcttggtccaggcccgttgggggggtcccctggagacttctccctgtgcagcctctggattcaacctttaggaactnttggatgaggttgggtccgccaggcctggcgaggggaaaggggtctggggacgtgggactgggaccaaacnttaaccggagggttagatagggaagaaggaagaatactatggtgtactcgtggtaggaacgggccgattcaccatccgtacganagaacaacgactaanatactacgtnttatttaacaagtnaagacacgngagagacgacgactacgtctntactatagtacgtacggagggacggggaaggtggaggtcggtcggtacggtcggtaccgggtacgg

SEQ ID NO: 312760 - DNA, 686 bp, Homo sapiens
  misc_feature: GZ8MTXP02HJI3R.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctcgtggattctaccgtttaggaactagttgatgtaggtttcgggtccgccgaggcgtgacggaggggaaggggtcgtggggaggttggggtacggacccgaaacgagtaggaacgggtaagagtagggaaaggagaaacgaaatacgtagtgtacgggacttcgtaggtagggaacggggccgtaatttcccgaacctactcctaccgaagacgaaccgaaccggaaccaaaacgtaacttaccgtaacttaggttaacttttaaacaaaattacgaaacgcgtaccaggacgacgacggaagggactacggttactaggtaacttacgttagttaggtacggtacggtaaaagggttccgggggaagtaggggtaccggtggtaacgggggtcctaaccgggggtcggggaaacccccgggg

SEQ ID NO: 312761 - DNA, 564 bp, Homo sapiens
  misc_feature: GZ8MTXP02GARK3.39.16.B05.1.454.CMB.2.raw
  modified_base (306)..(306): a, c, t, g, unknown or other
  misc_feature (306)..(306): n is a, c, g, or t
  modified_base (359)..(359): a, c, t, g, unknown or other
  misc_feature (359)..(359): n is a, c, g, or t
  modified_base (504)..(504): a, c, t, g, unknown or other
  misc_feature (504)..(504): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagctctcctgtgcagcctcgtggattctaccttaggaactagttggatggagttgggtccnccgaggctgcgaggggaggggctgggaggtgggtcgacaacagtagagtaganaggaagagaagaatcgtatggtggactcgtggtaggaaggggtccgtattacaccatactacccgaagacgaaacaaccgaccaaagaattacctaactagttaatttaacaaatagaacagcctagagacgccgagacacgtangtatactagtgacgacggaaggggcaaggtggcgtcggacacgtcggggctaacccgggg

SEQ ID NO: 312762 - DNA, 731 bp, Homo sapiens
  misc_feature: GZ8MTXP02GGN4E.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctgggtggagtcgtgggggaggcgttggtccaggccggtgggggtccctggagtctctcctgtgcagcctctggtacttcctaacctttaggaacttagttggatggtaggtttcggggtcccaccgaggcctggacgaggggaaggggcgtggggaggtggggtcgaccgaaagagtaggaggtaagagtagggaaagaagaaagtaaaattctaagtggtaggtaacttcgtaggtagggaaacgggtcccgtaacgttacccaacccgtaacttcccgtaccgaaacggaacgaaacccgaaaaccgaacccgaaaaaggtaactttaccgtaaacctttaggtttaaaacttttaaaccaaaagtttaacgaaacgaaccgtccgtagaacggacggaccggaaaggaccgtacgttacgtagttaaacgttacttagtttaggacgggaaaggggaaacgggggtacaaggggtcgggtacggtacggggtacgttacgggtcgggggacccgaaaccccggggg

SEQ ID NO: 312763 - DNA, 685 bp, Homo sapiens
  misc_feature: GZ8MTXP02HDSAW.39.16.B05.1.454.CMB.2.raw
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctgggtggagtcggtgggggaggtcttgggtccaggccggtggggggtccctggagctctcctgtgcagcctctggacttcctaccgtttaggaacttagttggatggtaggtttcgggccgccgaggcctggacggaggggaggggcgtgggaggtggggtcgaccaacgagtagaggtagagtaggaagagaagaaatcgtagtggtaggacttgtaggtaggaacggggtcctagttacccaaccacttccgaccgaaggacgaaccgaaaccgacaaaagacttaccactttaagttaactttaaacaaaagtcgaaaaccacgtccgtaggaacgacggacccggaaggtaactacggttactaggttaacttaaacgttagttagggtacgggaaacgggggaaaacgggggtcaaggggtacgggcggttacggggaccgttaaccgggtccgggggaaacccgtaaaccccggggg

SEQ ID NO: 312764 - DNA, 640 bp, Homo sapiens
  misc_feature: GZ8MTXP02IS3C7.39.16.B05.1.454.CMB.2.raw
  modified_base (266)..(266): a, c, t, g, unknown or other
  misc_feature (266)..(266): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (581)..(581): a, c, t, g, unknown or other
  misc_feature (581)..(581): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattgggctgagcttgggttttccttgttgcttattttagaaggtgtccagtgtgaggtgcagcgtggtggagtcgtgggggagcttggtccagccgtgggggtccctgagactctcctgtgcagcctntggattccactttaggaacttatggatgaggttgggtcccgcaggctggcgaggggaaggggctgggaggttgggtcgaccaacagtaggaggtagatagggaaanagaanaaatctagtaggtcggactcgtggtaggaacggggtccgtattacccactatcctacgagtacgaaccaacgaccaaaagtacttacaaaccttgttaaacgtttaccaaaattacgaaacacgacgtagagaacgccggaaaggtaccacgttacgtagttaaatacgtttattaggtacgggaacggggtaaacgggggtanaagggttcggcggttacggggacgtttccgggtacgggggacccaaaacccccgggggg

SEQ ID NO: 312765 - DNA, 726 bp, Homo sapiens
  misc_feature: GZ8MTXP02G9SW6.39.16.B05.1.454.CMB.2.raw
  modified_base (322)..(322): a, c, t, g, unknown or other
  misc_feature (322)..(322): n is a, c, g, or t
  modified_base (362)..(362): a, c, t, g, unknown or other
  misc_feature (362)..(362): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttcctgttgctattttagaaggtgtccagtgtgaggtgcagcgtgggtggagttcggtgggggaggtcgttgggtccaggccggtggggggtccctgacgtactctccgtgtcgcacgcctgtggacttcaccgtttaggaactagttggatgaggttgggccncgaggctgcgaggggagggctgggaggtgggtcgaccaanagtaggaggtagagtagggaaagaggaaagaaattacgtagtaggtggtaccttcgtggtagggaacgggccgtaattacccaccgactccgtaccgaaggtaacgaaccgaaaccgaccaaaagtaaacttaccaacgttagttaaactttaaacgaaaacttacgaaaccgacgtacccgttaggaacgaacggaccggaaacgggtacctaaacgttaccgttaggttaaacttaaccgtttaaaggttagggttacgggaaaccgggggtaaaacggggggttaccgtaaggggtacggggtcggtacgggggtaccggtttaccgggtaccggggggaaccccggtaaacccccggggg

SEQ ID NO: 312766 - DNA, 656 bp, Homo sapiens
  misc_feature: GZ8MTXP02IWPWO.39.16.B05.1.454.CMB.2.raw
  modified_base (286)..(286): a, c, t, g, unknown or other
  misc_feature (286)..(286): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtgggggtccctgagactctcctgtgcagcctctggattcacctttaggaactnttaggatgaggtttgggtccgccgaggctggcgaggggaaggggcgtgggaggtggggtggccaanagtagacggtanagtaggaagagaagaaatagtagtgtaggactcgtgtagaagggtaccgattaccaccacgtcctaccgaaggacaaaccgaaaccgaccgtaaaagaacttacaaccgttaggttaaactttaacaaaaattacgaaaacaacgtaccgttacggaaagacggacccggaacggaaaccgtacggttaccgtaggtaaacttaaccgttaatttcgggaggtaccggggaaaggggggacgtaaggttggcggtacggggaccgtaccgtcgggggacccaaacccggggg

SEQ ID NO: 312767 - DNA, 565 bp, Homo sapiens
  misc_feature: GZ8MTXP02HOMH8.39.16.B05.1.454.CMB.2.raw
  modified_base (196)..(196): a, c, t, g, unknown or other
  misc_feature (196)..(196): n is a, c, g, or t
  modified_base (271)..(271): a, c, t, g, unknown or other
  misc_feature (271)..(271): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
  modified_base (454)..(454): a, c, t, g, unknown or other
  misc_feature (454)..(454): n is a, c, g, or t
  modified_base (490)..(490): a, c, t, g, unknown or other
  misc_feature (490)..(490): n is a, c, g, or t
  modified_base (546)..(546): a, c, t, g, unknown or other
  misc_feature (546)..(546): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtncagctggtgggagtcgtggggggaggcttgggtccaggccgtggggggtccctgagactctcctgtgcagcctcnggattcacctttaggaactagttggatggagttgggtcccgcgaggctggacgaggggaagggctggagtgggtgaccaanagtagagtagatggaagnaaggaatctagtcgtaggactntaggtgaacgggcgattcacatctcacgagacaacgcaaagacttacacttgtaaactttanaaactagaaacagacctgaagacggaccgagggacncgtactagtatactagttgtacgaccggggaagggggacaaggttcggcggtcggngtaccggcgggaccgacgg

SEQ ID NO: 312768 - DNA, 702 bp, Homo sapiens
  misc_feature: GZ8MTXP02HG7P1.39.16.B05.1.454.CMB.2.raw
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcacatggaattggggctgagctgggttttccttgttgctatttagaggtgtcagtgtgaggtgcagctgggtggagtcgtggggggaggcttggtccaggccggtcgggggggtcccnggagctctcctggtcncagcctgtcggattactacgttagaactattaggactggaggtttggggtcccgaccgtagggctggacgagggggaaggggcgtaggggaggtggggtcggacaacgtagaggaggtagagtaggaagagaagaaatntatggngtactcgtgtagacggggtcattccgactctactcccaagtacgaaccaagaccctaaagtaacttacacgtttaagtaaatttaaaccgaaaattcggaaaacctaaggaccgtaggtaaacggaacggaccccggaagaaccgtaacccggtattacggttaaacttaaccgttaattacgggggacgggtaaccgggggaaaaaggggggtccgtaaaggggtcggggtcccggggtaggggtaaccggtacggggtaaccccggggggtacgtaaaacccccccgggggg

SEQ ID NO: 312769 - DNA, 722 bp, Homo sapiens
  misc_feature: GZ8MTXP02FGOUL.39.16.B05.1.454.CMB.2.raw
  modified_base (259)..(259): a, c, t, g, unknown or other
  misc_feature (259)..(259): n is a, c, g, or t
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
  modified_base (356)..(356): a, c, t, g, unknown or other
  misc_feature (356)..(356): n is a, c, g, or t
tcagtcgcactagtcacgaccggtgctcgatttagagctcacgtattgggtttgaggtctcagagaggagccttagccctggactccaaggcctttccacttggtgatcagcactgagcacagaggactcaccatggaattggggctgagcttgggttttcctgttgctattttagaaggtgtccagtgtgaggtgcagctggtggagtcgtggggagcttggcagccgtgggggtccctgagactctctgtgcagctngtattctaccttaaggactatggatagtaggtggtccnccgaggcctgacgaaggggaggcgngggaggtcggggtcgaccgaacagtagaaggtanagtaggaaacgagaaagaaatcctaagtgtaggactcgtaggtggaaggggtacctatccgaaccattcccaacgtaacggacaaaaccaaccggacctaaaacgtactttaccgaaacgttggtttaaaccctttaaacgaaaattacgtaaaaccgaaccggttaccaacggtaaaccgggaacggccccggtaaaagggtaccctaaacccgttaacgtttaccgtaaagtttaaacttaccggtttagggaaaccggggtaaaccgggggtaaaaggggggccttaaagggggtcggtaacccgttcgggggtaaccgtaacccgggggttaccccgggggaaccggaaaaccccccggggg

SEQ ID NO: 312770 - DNA, 487 bp, Homo sapiens
  misc_feature: GZ8MTXP01BSOQO.39.6.A06.1.454.CMB.2.raw
  modified_base (390)..(390): a, c, t, g, unknown or other
  misc_feature (390)..(390): n is a, c, g, or t
  modified_base (458)..(458): a, c, t, g, unknown or other
  misc_feature (458)..(458): n is a, c, g, or t
  modified_base (474)..(487): a, c, t, g, unknown or other
  misc_feature (474)..(487): n is a, c, g, or t
tcagtcgcactagtcacgaccggtgctcgatttagatctactgacagggtggaaggagactgggtcatccagatgacccagtctccttccaccctgtctgcatctgtaggagacagagtcaccatcacttgccgggccagtcagagtattagtagctggttggcctggtatcagcagaaaccagggaaagtcccaaactcctaatttataaggcgtcgactttagaaagtggggtccatcaagttcagcgcagtggatctgggacagaattcagtctcaccatcagcagcctgcagcctgaagtattttgcaactttattactgccaaacagtataacttatttccgtactacttttggacccaagggggaacccaaagccttagggacnctacaaacgactgtggctgcaccatctgtctcatcttccgctatctagaactgtgcgactgagcgggntggcaaggcgcattgnnnnnnnnnnnnnn

SEQ ID NO: 312771 - DNA, 613 bp, Homo sapiens
  misc_feature: GZ8MTXP01AV9PE.39.6.A06.1.454.CMB.2.raw
  modified_base (212)..(212): a, c, t, g, unknown or other
  misc_feature (212)..(212): n is a, c, g, or t
  modified_base (255)..(255): a, c, t, g, unknown or other
  misc_feature (255)..(255): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (600)..(601): a, c, t, g, unknown or other
  misc_feature (600)..(601): n is a, c, g, or t
  modified_base (603)..(613): a, c, t, g, unknown or other
  misc_feature (603)..(613): n is a, c, g, or t
tcagtcgcactagtcacgaccggtgctcgatttagatctactgacagggtggaaggagactgggtcatccagatgacccagtctccttccaccctgtctgcatctgtaggagacagagtcaccatcacttgccgggccagtcagagtattagtagctggttggcctggtatcagcaagaaaccagggaaacgtcccaaacctcctaatttanaaggctcgactttagaagtggggtcccatcaaggttcagcggnagtggatcgtgggacagtaattcagtctcaccatcagcagcctgcagcctagaagtattttgactaactttattactcgaccaatacgttattaaacctttactttaccgtactacgttttacggacccgaaggggaacccaaggtccgtaggacgtactaaccgaaaacgtactgtacggctacgaccacccgtaattccgttacgtttaccttacctaacccgttcccccgtacctaacgttaccgtacggtaaaccgtaggttaccgaccgtaacgttcgggaacggtccggggtaccgtcgggaaccgaacgggtcccgaacgaagttaaggngngngngnngnnnnnnnnnnn

SEQ ID NO: 312772 - DNA, 568 bp, Homo sapiens
  misc_feature: GZ8MTXP01BI8KV.39.6.A06.1.454.CMB.2.raw
  modified_base (205)..(205): a, c, t, g, unknown or other
  misc_feature (205)..(205): n is a, c, g, or t
  modified_base (328)..(328): a, c, t, g, unknown or other
  misc_feature (328)..(328): n is a, c, g, or t
  modified_base (539)..(539): a, c, t, g, unknown or other
  misc_feature (539)..(539): n is a, c, g, or t
  modified_base (560)..(560): a, c, t, g, unknown or other
  misc_feature (560)..(560): n is a, c, g, or t
  modified_base (562)..(568): a, c, t, g, unknown or other
  misc_feature (562)..(568): n is a, c, g, or t
tcagtcgcactagtcacgaccggtgctcgatttagatctactgacagggtggaaggagactgggtcatccagatgacccagtctccttccaccctgtctgcatctgtaggagacagagtcaccatcacttgctgggccagtcagagtgttagcagcaacttagcctggtaccagcagaaacctggccaggcctccgaggctcctnatctatgatcgcctccacgaggccactggtactcccagccaggttcagtggcaagtgggtctgggacagagttcacgtctactattatcgaagcacggtcctagcctaagttcgtagaaagtnttttaacggccttaagttttatacgtgtacctaaagctaagttaataaagttcgaacgtggaccccttaagggttccgaccgaaagggtaccaagggtacgaaacttacgaaacgtacgtggtacgctgacaccgtatcttacgtactcgactttcctcccgactacgtacacgtaacgtcgtagcccgtaagtgacggggtcccggttancggggacaagggttccaagtngnnnnnnn

SEQ ID NO: 312773 - DNA, 458 bp, Homo sapiens
  misc_feature: GZ8MTXP02FRWSC.39.6.A06.1.454.CMB.2.raw
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (453)..(458): a, c, t, g, unknown or other
  misc_feature (453)..(458): n is a, c, g, or t
tcagtcgcactagtcacgaccggtgctcgatttagatctactgacagggtggaaggagactgggtcatccagatgacccagtctccttccaccctgtctgcatctgtaggagacagagtcaccatcacttgccgggccagtcagagtattagtagctggttggcctggtatcagcagaaaccaggaaagtcccaaacctctaattataaggcgtcgactttagaaagtgggtccatcaaggttcagcggcagtggatctgggacagaattcagtctcaccatcagcagcctgcagcctgaagattttgcaacttatactgccaanagtataatattcccgtanactttgctaggggccaagctggagctacaaacgaactgtggctgcaccatctgtcttcatcttcccgcatctgaactagtgcgactgagcgggctggcaaggcgcatagnnnnnn

SEQ ID NO: 312774 - DNA, 493 bp, Homo sapiens
  misc_feature: GZ8MTXP02HHD8O.39.6.A06.1.454.CMB.2.raw
  modified_base (485)..(485): a, c, t, g, unknown or other
  misc_feature (485)..(485): n is a, c, g, or t
  modified_base (487)..(493): a, c, t, g, unknown or other
  misc_feature (487)..(493): n is a, c, g, or t
tcagtcgcactagtcacgaccggtgctcgatttagatctactgacagggtggaaggagactgggtcatccagatgacccagtctccttccaccctgtctgcatctgtaggagacagagtcaccatcacttgccgggccagtcagagtattagtagctggttggcctggtatcagcagaaaccagggaaagtcccaaacctcctaatttataaggcgtcgactttagaaagtggggtcccatcaaggttcagcggcagtggatctgggacagaattcagtctcaccatcagcagcctgcagcctgaagtattttgactaaactttatactgaccaaacagtataacttactttacccgtactacttttggaccaggggaccaaagctaggagcctacaaaacgactgtggctgcaccatctgtcttacatccttccgacattctagtaactagtcgacgactgagcgggctggacgaaggcgacangnnnnnnn

SEQ ID NO: 312775 - DNA, 482 bp, Homo sapiens
  misc_feature: GZ8MTXP02I7PYP.39.6.A06.1.454.CMB.2.raw
  modified_base (209)..(209): a, c, t, g, unknown or other
  misc_feature (209)..(209): n is a, c, g, or t
  modified_base (474)..(482): a, c, t, g, unknown or other
  misc_feature (474)..(482): n is a, c, g, or t
tcagtcgcactagtcacgaccggtgctcgatttagatctactgacagggtggaaggagactgggtcatccagatgacccagtctccttccaccctgtctgcatctgtaggagacagagtcaccatcacttgccgggccagtcagagtattagtagctggttggcctggtatcagcagaaaccagggaaagtcccaaactcctaatttanaaggcgtcgactttagaaagtggggtcccatcaaggttcagcggcagtggatctgggacagaattcagtctcaccatcagcagcctgcagcctgaagattttgcaaacttatactgaccaacagtaataaactttatttacccgtactacttttggcctaggggaccaaagctggagctacaaaacgaactgtggctgcaccatctgtcttcacttcccgcatctagaactagtgtcgaactgagcgggctggcaagcgcatagnnnnnnnnn

SEQ ID NO: 312776 - DNA, 691 bp, Homo sapiens
  misc_feature: GZ8MTXP02G9B0C.39.6.A06.1.454.CMB.2.raw
  modified_base (311)..(311): a, c, t, g, unknown or other
  misc_feature (311)..(311): n is a, c, g, or t
  modified_base (663)..(663): a, c, t, g, unknown or other
  misc_feature (663)..(663): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (682)..(682): a, c, t, g, unknown or other
  misc_feature (682)..(682): n is a, c, g, or t
  modified_base (684)..(685): a, c, t, g, unknown or other
  misc_feature (684)..(685): n is a, c, g, or t
  modified_base (687)..(687): a, c, t, g, unknown or other
  misc_feature (687)..(687): n is a, c, g, or t
  modified_base (689)..(690): a, c, t, g, unknown or other
  misc_feature (689)..(690): n is a, c, g, or t
tcagtcgcactagtcacgaccggtgctcgatttagatctactgacagggtggaaggagactgggtcatccagatgacccagtctccttccaccctgtctgcatctgtaggagacagagtcaccatcacttgccgggccagtcagagtattagtagctggttggcctggtatcagcagaaaccagggaaagtcccaaacctcctaatttataaggcgtcgactttagaaagtggggtcccatcaaggttcagcggcagtggatcgtgggacagaattcagtctcaccatcagcagcctgcagcctagaagtnttttgactaaactttattactgacctaactagttaattaaactttactttaccccgtaacttaccgtttttcggacccgtaacggggaccctaaaggtccgttaggggaacgtaccgttaaccgaaaaaccggtaaaccgttgggttacgggaccttacggacctaaccctaacgtttccttcgttacctttacctaactttccccgtttacccccggtacccttaacgtttacccgttaacggtaaaaccgttacgggttcgggtacccgtaaccgttcggggaacgggtcccgggggtaccgttacgggggacccgtaaaacgggggcccgaaccggtaacgttaacggngacgacgcgcgncngcacncnncncnng

SEQ ID NO: 312777 - DNA, 527 bp, Homo sapiens
  misc_feature: GZ8MTXP02IVJ8Q.39.6.A06.1.454.CMB.2.raw
  modified_base (389)..(389): a, c, t, g, unknown or other
  misc_feature (389)..(389): n is a, c, g, or t
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
  modified_base (516)..(527): a, c, t, g, unknown or other
  misc_feature (516)..(527): n is a, c, g, or t
tcagtcgcactagtcacgaccggtgctcgatttagatctactgacagggtggaaggagactgggtcatccagatgacccagtctccttccaccctgtctgcatctgtaggagacagagtcaccatcacttgccgggccagtcagagtattagtagctggttggcctggtatcagcagaaaccagggaaagtcccaaactcctaatttataaggctcgactttagaaagtggggtcccatcaagttcagcggcagtgatcgtggacagaatcagtctcacatcagcagcctgcagcctgaagtattttgctaactttattactcgacctaacagtattaactttactttcccgtactacttttcggaccaggggaccaagtctagggacncctacgaaacgtaactgtagctgacaccgtactctcgttcttctacttccttcccgactactctacgaacttagtcgaccgtacgtggaggtcgggacgtcggacgaacggcgacgagtagnncncnnnnnnnnnnnn

SEQ ID NO: 312778 - DNA, 706 bp, Homo sapiens
  misc_feature: GZ8MTXP02IVZFA.39.6.A06.1.454.CMB.2.raw
  modified_base (204)..(204): a, c, t, g, unknown or other
  misc_feature (204)..(204): n is a, c, g, or t
  modified_base (475)..(475): a, c, t, g, unknown or other
  misc_feature (475)..(475): n is a, c, g, or t
tcagtcgcactagtcacgaccggtgctcgatttagatctactgacaaacacacaagggggaggaactgctcagttaggacccagacggaaccatggaagccccagcgcagcttctcttcctcctgctactctggctccagataccactggagaagtagtgatgacgcagtctccagccaccctgtctgtgtctcgaaggggaangccacctctcctgcgagggccagtcagtactatagcagactaacgttagccgtaggtaccaagaacctaaaaaccgtgggacccaacggacccttaccccgaaggtccctaccccgtactaatcggtttagtgggtcgcccgttaccaaccggtaccgggaccctacgttacggtaaccctcccgaacgtccggttaacggttcccgtacggtcggcgtaagggttcggggttacgcggggactggtacgtttcgaagttcctacgacgtnacgagcacgtcgtgtacgacgttacgtagttaagtttacttttacgttaacttttacttacgtgttacgtagtactaggttatacgtacgttaccgtcgtaccttacgtaaccgtttcgtttaccggtaccgggtacggggtaacggtttacggtagggacgtaacgtaaaccgtaaaaccggtaaggttcggtacgtaacggtcgtaccgtaaactcggttacctttccg

SEQ ID NO: 312779 - DNA, 575 bp, Homo sapiens
  misc_feature: GZ8MTXP01C2THA.52.53.E09.1.454.CMB.2.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(575): a, c, t, g, unknown or other
  misc_feature (574)..(575): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagtctttatgtcggtggtaccacatattatgctgactcgtgaaggccattcaccatcnccagagacgagtccaggaacagcctgttctcaaatggacagtctgagacctgacgacacggctgtctattacngtgcgagacgaaccgagggggcggancacgccccgtatcgnggggcccaaaggggaacccggtcacccgtctccctacacgcccctaccaaacccgaacgggccccacgtcccgggtcccttcccccgtcggcccacccctcctaccgaaacgacgccaccgtcgcgggggggcacgacggccggccctggggcctcggccctgggtcaacggacctacttccctaattcgattcgctgagcgggctggcaaggcganangnn

SEQ ID NO: 312780 - DNA, 545 bp, Homo sapiens
  misc_feature: GZ8MTXP01DJJFO.52.53.E09.1.454.CMB.2.raw
  modified_base (206)..(206): a, c, t, g, unknown or other
  misc_feature (206)..(206): n is a, c, g, or t
  modified_base (243)..(243): a, c, t, g, unknown or other
  misc_feature (243)..(243): n is a, c, g, or t
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagttctttatggtcggtggtaccanatattatgctgactccgtgaagggccattcaccatcnccagagacgagtccaggaacagcctgtttcttcaaatggacagtctgagacctgacgacacggctgtctattactgtgcgagagaacccgagggggcggancacgccccgtaattcgngggggccaaggggaacccggtcaccgtctcctcacgcctcaccaacgggcccatccggtccttccccgtggccaccctcctccaagacgccacgtccgtggggggggcacgacgccggccctgggctgccctggtcaaggctactctattcgattcgctgagcgggctggcaaggcgcatgngn

SEQ ID NO: 312781 - DNA, 584 bp, Homo sapiens
  misc_feature: GZ8MTXP01CWOLE.52.53.E09.1.454.CMB.2.raw
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (340)..(340): a, c, t, g, unknown or other
  misc_feature (340)..(340): n is a, c, g, or t
  modified_base (437)..(437): a, c, t, g, unknown or other
  misc_feature (437)..(437): n is a, c, g, or t
  modified_base (459)..(459): a, c, t, g, unknown or other
  misc_feature (459)..(459): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgaggggaagggctggagtgggtctcaagtctttangtcggtggtaccanatattatgctgactccgtgaaggccattcaccatcnccagagacgagtccaaggaacagcctgttctacaaatggacagtctgagacctgacgacacggctgtctattacngtgcgagacgaacccgagggggcggancgaccgccccgtaaatcgtcggggaccaagggaaccccgggtcaccgtctcccgtcacgccctacacccgaacgggcccagtccggtccttccccgnggccacccctccaccaagaccnccaccgtcggcggggggcacgacgccggccgtcggcgtcgaccgtcgtaccgaacgtaccttactcctaagttacgacttcgcgtcggacggcgggcgtcggacgaacggcgacgacgtaagngn

SEQ ID NO: 312782 - DNA, 544 bp, Homo sapiens
  misc_feature: GZ8MTXP01DXLII.52.53.E09.1.454.CMB.2.raw
  modified_base (200)..(200): a, c, t, g, unknown or other
  misc_feature (200)..(200): n is a, c, g, or t
  modified_base (355)..(355): a, c, t, g, unknown or other
  misc_feature (355)..(355): n is a, c, g, or t
  modified_base (518)..(518): a, c, t, g, unknown or other
  misc_feature (518)..(518): n is a, c, g, or t
  modified_base (542)..(544): a, c, t, g, unknown or other
  misc_feature (542)..(544): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaagggctggagtgggtctcaagtctttatgtcggtggtaccanatattatgctgactccgtgaagggccattcaccatctccagagacgagtccaaggaacagcctgtttctcaaatggacagtctgagacctgacgacacggctgtctattactgtgcgagacgaacccgagggggcggagcacgccccgtaatcgnggggcccaaggggaacccgggtcaccgtctcctcacgccctcaaccaagggcccatcggtccttcccctggccaccctcctccaagacgcacctcgtggggggggcacgacgcggcccgtgggttcgccgtggtcaaggtactacttcctaatcgatcgctgngcgggcttggcaaggcgcattagnnn

SEQ ID NO: 312783 - DNA, 591 bp, Homo sapiens
  misc_feature: GZ8MTXP01C8BD5.52.53.E09.1.454.CMB.2.raw
  modified_base (226)..(226): a, c, t, g, unknown or other
  misc_feature (226)..(226): n is a, c, g, or t
tcagcgcagtacgacacgaccggtgctcgatttagagagagtgtgttgggtttgggggctgtgggtccaggaggcagaactctgggtgtctcaccatggcctggatccctctacttcctcccctcctcactctctgcacaggctctgaggcctcctatgagctgacacagccaccctggtgtctgtcgtcctcaggacagacggccaggatcacctgctcgtgganatgctattgaccaaagcaatatgcttactggacagcagaacgcccggcacggccctgtctgctttattactaaagctttgagtacgccctcgacgggacccctgacgcgtacttccgtctcggacctccaagtcctcgacgaccgaacaaacgtcgtactaacgttcgaaccctagtaccgaaggttcggacgtacccgaggacagggacggacgagtctagacttagttaactgtacacttcacgtcagacagtacgagtacggtacgtaacttaacgttggttacgttacgttacggtacgggaacgggttaaccgaaacgtaacgtaccgtaacgtacgtacgaccgtaaccgaacgtcccg

SEQ ID NO: 312784 - DNA, 566 bp, Homo sapiens
  misc_feature: GZ8MTXP01AH6S8.52.53.E09.1.454.CMB.2.raw
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgaggggaaggggctggagtgggtctcaagttctttatgtcggtggtaccanatattangctgactccgtgaaggccattcaccatctccagagacgagtccaggaacagcctgttctcaaatggacagtctgagacctgacgacacggctgtctattactgtgcgagacgaacccgagggggcggagcacgccccgtaatcgnggggccaaggggacccggtnaccgtctcctcacgcctccaccgaacgggcccagtccggtccttccccgtcggcccaccctcctaccaacgacgccacctcgtcgggggggggcacgacggccggcccgtcggggcctcggcccgtggtccaacggacctacttcctagttacgacttcgctgacggcgggctgggcaaggcgcatgngn

SEQ ID NO: 312785 - DNA, 601 bp, Homo sapiens
  misc_feature: GZ8MTXP01AKTNT.52.53.E09.1.454.CMB.2.raw
  modified_base (207)..(207): a, c, t, g, unknown or other
  misc_feature (207)..(207): n is a, c, g, or t
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgagggaagggctggagtgggtctcaagtctttatgtcggtgtaccacatattangctgactccgtgaaggccattcaccatctcagagacgatccaggacagcctgttctcaaatggacagtctgagacctgacgacacggctgtctattactgtgcgagacgaccgngggggcggagcacgccccgtatcgnggggccaacgggacccgtcaccgtctcctcgacgcctaccaccgaacgggccctagtccggtcccttcccccgtggccctacccctccctaccgaaagcgccaccgtcggtcggggggggacacgacggcccggcccgtggggcctcggacccgttcgggtaccaaacgggtaccttaccgttcctaagttaccggacttcgtccgttggacgggcgggttcctggggccaacggggcccagaacgttcggngng

SEQ ID NO: 312786 - DNA, 593 bp, Homo sapiens
  misc_feature: GZ8MTXP01CLC2P.52.53.E09.1.454.CMB.2.raw
  modified_base (204)..(204): a, c, t, g, unknown or other
  misc_feature (204)..(204): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagtctttatgtcggtggtaccanatattatgctgactcgtgaaggccattcaccatctccagagacgagtccaggaacagcctgtttctnaaatggacagtctganacctgacgacacggctgtctaattacngtgcgagacgaaccgagggggcggancacgcccgtaatcgnggggccaacggggaacccgtcaccgtctcctcagccctacgaaccgacgggcccatccggtcttcccccgtggccacccctcctaccaagacgacaccgtcgtcgggggggcacgacgccggccgtcgggctcgccgtcgtaccgaaacggtacctacttccctaacttacggacttcgaccttgggacggcggggcccgtaaggggacccgaagggcccggtaacgacgtaagngng

SEQ ID NO: 312787 - DNA, 510 bp, Homo sapiens
  misc_feature: GZ8MTXP01DBEMN.52.53.E09.1.454.CMB.2.raw
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacactagccatcgcatggcatcagctgcagccagagaaggccctggtacttgatgaggctcaacagtgatggcagccacagcgaggggggaccgtatccgtgatcgcttctcgaggctccggctcgtggggactgagcgctactcaccatctccagcctcagtctagaggacggaagggtgaactattacgtgtacaggaacgtgggactacgtgggctaagtttggggttgttcgggcggagggtaccaaggttcgaccgtctaggtcaggccaggtcttcgtccccg

SEQ ID NO: 312788 - DNA, 593 bp, Homo sapiens
  misc_feature: GZ8MTXP01DMMIU.52.53.E09.1.454.CMB.2.raw
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagctgcagccagagaaggccctcggtacttgatgaggctcaacagtgatggcagccacgagcggacggggggaccgtacgtaccgtgactcgaccttctcgaggtccgtccggctcgtgggactgacgcgactacctcacctatcctccagccctcagtctaggacggacgggtagggtgaacttacgttaacgtcgtacgaggtacggttcggggaactaccggtgggtccgttaaggtttgggggttcgtttccggggcgggtaacgggtacccgttaaagggttcggaacccggttcgtaacgggtccgacggaccccgaaggtcccgttccggtcccccccgg

SEQ ID NO: 312789 - DNA, 514 bp, Homo sapiens
  misc_feature: GZ8MTXP01BNXR0.52.53.E09.1.454.CMB.2.raw
  modified_base (144)..(144): a, c, t, g, unknown or other
  misc_feature (144)..(144): n is a, c, g, or t
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
  modified_base (507)..(507): a, c, t, g, unknown or other
  misc_feature (507)..(507): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccnccaggctccagggaagggctggagtgggtctcaagtctttatgtcggtgtaccacatattatgctgactccgtgaaggccattcaccatctccagagacgagtccaggacagcctgttctcaaatggacagtctgagacctgacgacacggctgtctattacngtgcgagagaacccgngggggcggancacgccccgtaatcgnggggccaagggaacccggtnaccgtcnctcacgcctcacaggccatcgtctccctgccacctcctcagacgcaccgtcgtcggggggcacgacgcggccctgggctcgacctggtcaacggctctcctattcgacttcgctgcgcggctggcaaggcncatgngn

SEQ ID NO: 312790 - DNA, 528 bp, Homo sapiens
  misc_feature: GZ8MTXP01BTFNQ.52.53.E09.1.454.CMB.2.raw
  modified_base (263)..(263): a, c, t, g, unknown or other
  misc_feature (263)..(263): n is a, c, g, or t
  modified_base (337)..(337): a, c, t, g, unknown or other
  misc_feature (337)..(337): n is a, c, g, or t
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgcacagggtctctctcccagcctgtgctgactcaatcgccctctgcctctgccctccctgggagcctcggtcaagctcacctgcactctgagcagnggcactacacctacgccatcgcatgcatcagctgcagccagagaacggccctggtactgatgaggctacaaacngtgatcgggcacgccacgaggcggagggggacgtactcccgtagactcgtcttcgtcgacgggcctccggctcgtcgggacgtggacgccgcctacctccaccatcctccacgcctccacgtctagacgggtacgagggtctacttagttcttggtcacggcgtcggggacttacgtggttccgttaaggg

SEQ ID NO: 312791 - DNA, 540 bp, Homo sapiens
  misc_feature: GZ8MTXP01DBX29.52.53.E09.1.454.CMB.2.raw
  modified_base (144)..(144): a, c, t, g, unknown or other
  misc_feature (144)..(144): n is a, c, g, or t
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
  modified_base (468)..(468): a, c, t, g, unknown or other
  misc_feature (468)..(468): n is a, c, g, or t
  modified_base (508)..(508): a, c, t, g, unknown or other
  misc_feature (508)..(508): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccnccaggctccgaggggaagggctggagtgggtctcaagttctttatggtcggtgtaccanatattangctgactcgtgaaggccattcacatcncagagacgagtccaaggaacngccttgttctacaaatggacagtcngacacctgacgacacggctgtctattactgngcgagacgaccgngggggcgancacgcccgtatgngggccaagggaccgtcaccgtctccnacgccacaacgacggcccagtccgtcctcccgtcgaccctaccctccacgaagcgaccaccgtcggcggggggcaacgcgccggccgtgggcncgcgtcgacaaggtcctactcctattacgacttcgtacgnggcggcggcgtcggacgaacggcacagtgngn

SEQ ID NO: 312792 - DNA, 512 bp, Homo sapiens
  misc_feature: GZ8MTXP01CCHTJ.52.53.E09.1.454.CMB.2.raw
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (442)..(442): a, c, t, g, unknown or other
  misc_feature (442)..(442): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcaactacacctacgccatcgcatggcatcagcngcagccagagaacggccctggtactgatgagctacaangtgatggcagcacgagcgacgggggacgtatccctgactcgcttcncgaggcctccggctcgtgggactgagcnctaccncacatccacagccctccagtcaggagggggacgtaggggtcacgttattaccgtgtacgaaggcgtgggacncgtggaactggttgggtgttcgggacgggaggacgagttcgccgtcgtaaggcacgccgaaggctcccgg

SEQ ID NO: 312793 - DNA, 532 bp, Homo sapiens
  misc_feature: GZ8MTXP01AGM80.52.53.E09.1.454.CMB.2.raw
  modified_base (252)..(252): a, c, t, g, unknown or other
  misc_feature (252)..(252): n is a, c, g, or t
  modified_base (364)..(364): a, c, t, g, unknown or other
  misc_feature (364)..(364): n is a, c, g, or t
  modified_base (449)..(449): a, c, t, g, unknown or other
  misc_feature (449)..(449): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcgagtggcacgtacacctacgccatcgcatggcatcagcngcagccagagaaggccctggtacttgatgaggctcaacagtgatggcagccacaggcgaggggggacgtatcccgtgatcgcttctcgacgggctccggctcgtgggactgngcgctactcaccatctccagccctcacgtctgacggggacggagggtcggacttataactcgtcgagtacgtgggacgacgtggngtgttgggtcggttcggtcgggacgggacgttaacgttcgtaaccggtccgtaacggtcgacgacccgtaacggcgtccccgg

SEQ ID NO: 312794 - DNA, 547 bp, Homo sapiens
  misc_feature: GZ8MTXP01DJN23.52.53.E09.1.454.CMB.2.raw
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttcctgttgctatttaaaggtgtcagtgtggagtgcaggtggtggagtcgtgggggagcttggtccagcctggtgtccctgagactctcctgtgcagcctcnggatctccgtcagtagcaaactacatgagcgtggtccncaggctccgaggggagggctgggagtgggtctcgaagttcctttagnggtcggtgtacccaanatntangctgactcgtgaaggcatcacatctcagagacganccaggaaacncgtcttgttactanaagtgactgtctagacgcctagacgacgcggtctgttacttattacgtggtcgacgacggaaccggaacccggggagggggtccggacgaccgttaccggtaaccccgttaacgtcggg

SEQ ID NO: 312795 - DNA, 647 bp, Homo sapiens
  misc_feature: GZ8MTXP01DOVYK.52.53.E09.1.454.CMB.2.raw
  modified_base (307)..(307): a, c, t, g, unknown or other
  misc_feature (307)..(307): n is a, c, g, or t
  modified_base (451)..(451): a, c, t, g, unknown or other
  misc_feature (451)..(451): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttccttgttgcttatttaaaaggtgtccagtgtggagtgcaggtggtggagtcgtggggggagcttggtccagcctggtggttccctgagactctcctgtgcagcctctggatctccgtcagtagcaaactacatgagctgggtccnccaggctccgagggggaacggggctgggagtcgggtctcgaaagttcctttatggtcggtggtaacccaactaattaattatgctgactcgtgaaacgggccctattccaccatcctacaagacgacgagtcccaaggaaaccngtccttgggtttaccttagaaaatcgggaacctaggttccaggaaacgcccttggaacccgacgaaccggggtcttaggttaccttaaagttacgtcggtacggacggaaacgggaaacccgggaaaccccgggggaagggggggtcccggaacgtacccggaacccggttaaccccccggtttaaggttccgggg

SEQ ID NO: 312796 - DNA, 584 bp, Homo sapiens
  misc_feature: GZ8MTXP01ESVLA.52.53.E09.1.454.CMB.2.raw
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
  modified_base (282)..(282): a, c, t, g, unknown or other
  misc_feature (282)..(282): n is a, c, g, or t
  modified_base (320)..(320): a, c, t, g, unknown or other
  misc_feature (320)..(320): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaagggctggagtgggtctcaagtctttangtcggtggtaccanatattangctgactccgtgaagggccattcaccatctccagagacgagtccaggaacagcctgtttctcaaatggacagtcntgacgacctacgacgacgacgctgtactattactgtgncagagaaacccgacgggggcggggaagcaacgcccgtaaacgttctggggccgacggggaaacccgggtccgaccgtcctcctcacgcctcccaacccaaacgggacccgactaccggtccttccccctcgaccaccccgtccctacccaaacgaacgaccaaccctaccgtcgggggcgaccaacgaccgggcccgtcgggcgtcgccgtcggttcgaaacggaacttacgttccttactaacgatcgctcgagcgggcgtgg

SEQ ID NO: 312797 - DNA, 549 bp, Homo sapiens
  misc_feature: GZ8MTXP01BA98I.52.53.E09.1.454.CMB.2.raw
tcagcgcagtacgacacgaccggtgctcgatttagagagagtgtgttgggtttgggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcaagaacgcccggacacggcccctgtcttgctttaatttaataaagtactttgacgacggtccctcgacggaccctgacgcgtacttctcgtggcctccgaagctcagcgaacaactacgtacacgttgacccagtacaggtggacgtccgaggcaggaggacgagctagtaacttagttacgtgtcagtcatacagacagctaggtcgcctaatttagttggtacgttaagtccgggacggaacgggacaaacgtcgaccgtcgtaaggtccacgcccgaagtcccg

SEQ ID NO: 312798 - DNA, 583 bp, Homo sapiens
  misc_feature: GZ8MTXP01BOVZD.52.53.E09.1.454.CMB.2.raw
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
  modified_base (377)..(377): a, c, t, g, unknown or other
  misc_feature (377)..(377): n is a, c, g, or t
  modified_base (534)..(534): a, c, t, g, unknown or other
  misc_feature (534)..(534): n is a, c, g, or t
  modified_base (546)..(546): a, c, t, g, unknown or other
  misc_feature (546)..(546): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggtttccttgttgctatttaaaaggtgtccagtgtggagtgcgaggtggtggagtcgtgggggagcttggtccagcctggtggttccctgagactctcctgtncagcctctggatctccgtcagtagcaactacatgagctgggtccncaggctccgagggggaacgggctgggagtgggtctcgaagttcctttagtggtcggtggtacccaactagttnttagtgctaggacctccgggtagaaacgggcccgtattccacctatcctaccgaagacgacgagtccgagaacagtcccttagggtttcttacaaagtggactaggtccagtacgcctggacgaccacgggtctgttccgtattaccgtggtcgcgngacgaacccggngggggccgagccgacggtcccccgttaaggtcccggg

SEQ ID NO: 312799 - DNA, 569 bp, Homo sapiens
  misc_feature: GZ8MTXP01DL1LY.52.53.E09.1.454.CMB.2.raw
  modified_base (205)..(205): a, c, t, g, unknown or other
  misc_feature (205)..(205): n is a, c, g, or t
  modified_base (359)..(359): a, c, t, g, unknown or other
  misc_feature (359)..(359): n is a, c, g, or t
  modified_base (552)..(552): a, c, t, g, unknown or other
  misc_feature (552)..(552): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagttctttatggtcggtgtaccanatattatgctgactccgtgaaggccattcaccatctcagagacgagtccaggaacagcctgtttctacaaatggacagtctgagacctgacgacacggctgtctattactgtgcgaagacgaacccgagggggcggagcacgccccgtaatcgnggggccaaacggggacccggtcaccgtctccctcacgccctaccaaccgaacggcccacgtccggtccttcccccgtcggcccacccctcctaccaacgacgccaccgtcgtcggggggggcacgacggccggcccgtgggctcgccgtcggtcaacggacctactctacttacgacttcgctgacgcgggcnggcaaggcganatgngn

SEQ ID NO: 312800 - DNA, 566 bp, Homo sapiens
  misc_feature: GZ8MTXP01DLWN2.52.53.E09.1.454.CMB.2.raw
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (560)..(560): a, c, t, g, unknown or other
  misc_feature (560)..(560): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaagggctggagtgggtctcaagtctttatggtcggtggtaccanattattangctgactccgtgaaggccattcaccatctcagagacgagtccaaggaacagccttgtttctacaaatggacagtctgacgacctgacgacacggctgtctattactgtgcgagacgaccgagggggcgagcacgccccgtatcgcggggccaagggacccgtnaccgtctccncacgccctcaaccgacggcccagtcggtcctccccgtgccaccctcaccaagacgcaccgtcgtcggggggccacgacggccggcccgtcggggcttcggcccgtggtacgaacggtaccttacgttaacctaattaccgattcgcgtggacgcgggacgtgggacaagggccgnatgngn

SEQ ID NO: 312801 - DNA, 544 bp, Homo sapiens
  misc_feature: GZ8MTXP01DY7EO.52.53.E09.1.454.CMB.2.raw
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgcctctgcctctcgcctcccgtgggacgcctcggtcaagctcacctgcactctgagcagtgggcactacacctacgcatcgcatgcatcagctgcagccagagaacggccctcggtacttgatgacggctcaacagtgaatgggcacgccaagaggcggaggggggaccgtactcctgactcgcttctcgacggctccggctcgtggggactgacgcgactacctcaccatcctccacgcctcagtcngaggacgggagggtnactatacgtgtacgagtaacggtgggaacacgtggcgtaaggtttgggttggttcggacgggagggaccgttaaggttcgacccgttcgaggtccacgcccgaacggtccgttccgtcccccg

SEQ ID NO: 312802 - DNA, 536 bp, Homo sapiens
  misc_feature: GZ8MTXP01BOFJ9.52.53.E09.1.454.CMB.2.raw
  modified_base (263)..(263): a, c, t, g, unknown or other
  misc_feature (263)..(263): n is a, c, g, or t
  modified_base (331)..(331): a, c, t, g, unknown or other
  misc_feature (331)..(331): n is a, c, g, or t
  modified_base (340)..(340): a, c, t, g, unknown or other
  misc_feature (340)..(340): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
  modified_base (418)..(418): a, c, t, g, unknown or other
  misc_feature (418)..(418): n is a, c, g, or t
  modified_base (471)..(471): a, c, t, g, unknown or other
  misc_feature (471)..(471): n is a, c, g, or t
  modified_base (510)..(510): a, c, t, g, unknown or other
  misc_feature (510)..(510): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgaggggaagggctggagtgggtctcaagttctttatggtcggtggtaccacattattatgctgactccgtgaaggccattcaccatctccagagacgagtccaaggaacngcctgttctacaaatggacagtctgagacctgacgacacggctgtctattactgtgcgagacgaccgngggggcgancacgcccgtatcgcggggccaagggacccgtcaccgtctccncacgccnccgacacggccagtccggtccttccccgnggccctaccctcctacccaagacgccacgtcgtcggggggcacgcgccggccngggctgcctgtcaagcctactctattacgattcgcgtgnggcgggctggacaaggcacagtgngn

SEQ ID NO: 312803 - DNA, 596 bp, Homo sapiens
  misc_feature: GZ8MTXP01EL5B8.52.53.E09.1.454.CMB.2.raw
  modified_base (205)..(205): a, c, t, g, unknown or other
  misc_feature (205)..(205): n is a, c, g, or t
  modified_base (273)..(273): a, c, t, g, unknown or other
  misc_feature (273)..(273): n is a, c, g, or t
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
  modified_base (356)..(356): a, c, t, g, unknown or other
  misc_feature (356)..(356): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaagggctggagtgggtctcaagttctttatggtcggtggtaccanatattatgctgactcgtgaagggccattcacatctccagagacgagtccaggacagccttgtttctanaaatggacagtcgagacctgacgacacggctgtctattacngtgcgagacgaccggngggggcgagcacgcccccgtattcgnggggccacggggaaaccccggtcaaccggtctcccgtcacgccctacgacgaacgggccacgtcggtcctcccgtcgcccacccgtcctacaacgacgccaccgtcgtcggggaccaacggcggcccggcccgtcgggcctcggccgtacggtaccgtaacggtaccttaccgtcctaacgtaacgttacgtcgcgtcggacggcgggttcgcgggaacgaacgggcgacgagagtgngn

SEQ ID NO: 312804 - DNA, 587 bp, Homo sapiens
  misc_feature: GZ8MTXP01CU4VL.52.53.E09.1.454.CMB.2.raw
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (264)..(264): a, c, t, g, unknown or other
  misc_feature (264)..(264): n is a, c, g, or t
  modified_base (402)..(402): a, c, t, g, unknown or other
  misc_feature (402)..(402): n is a, c, g, or t
  modified_base (454)..(454): a, c, t, g, unknown or other
  misc_feature (454)..(454): n is a, c, g, or t
  modified_base (471)..(471): a, c, t, g, unknown or other
  misc_feature (471)..(471): n is a, c, g, or t
  modified_base (578)..(578): a, c, t, g, unknown or other
  misc_feature (578)..(578): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgaggggaaggggctggagtgggtctcaagttctttatgtcggtggtaccanatattangctgactccgtgaacgggccattcaccatctccagagacgagtccaaggaacngccttgtttctacaaatggacagtctagacgacctgacgacacggctgtctattactgtgacgaagacgaacccggagggggcggagccgaccggtccccgtaagtcgacgggggacccgaaacggggaaccccggtnacccgtctcccgtcacgccctaccgacgacggccagtccggtccttccccgngccaccctcaccaagcncacgtcgcgggggcacgcgccggccgtcggctcggccgtggccgaacggtaccttacgtcctaagttaccggcttcggtctgggacgcgggctcgggacgaagggcnttagtgngn

SEQ ID NO: 312805 - DNA, 510 bp, Homo sapiens
  misc_feature: GZ8MTXP01EY0TH.52.53.E09.1.454.CMB.2.raw
  modified_base (255)..(255): a, c, t, g, unknown or other
  misc_feature (255)..(255): n is a, c, g, or t
  modified_base (264)..(276): a, c, t, g, unknown or other
  misc_feature (264)..(276): n is a, c, g, or t
  modified_base (354)..(358): a, c, t, g, unknown or other
  misc_feature (354)..(358): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattatgctgactccgtgaagggccattcaccatctccagagacgatccagacngcctgttcnnnnnnnnnnnnnacgacgacgtacgtacgtacgtacgtacgtcgtcgtacgacgacggacggacggaccgacgcgcgcgcgacgcgcgcnnnnntntntntctcgtacgtccgcgtcccgactactcgtcncgccgtccgcctccnccgtctcgccgccgccgccgccgccgtccgtccgtccgtcgccgccgtccgtcgcgtcgcgtccgtcgcgcgacgtcgtcgtccgtcgcgcgtcgcgtcg

SEQ ID NO: 312806 - DNA, 596 bp, Homo sapiens
  misc_feature: GZ8MTXP01AUV2H.52.53.E09.1.454.CMB.2.raw
  modified_base (355)..(355): a, c, t, g, unknown or other
  misc_feature (355)..(355): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaaggccattcaccatctccagagacgagtccaaggaacagcctgtttcttcaaatggacagtctgagacctgacgacacggctgtctattactgtgcgagagaacccgagggggcggagcacgccccgtaatcgnggggcccaaaggggaacccgggtcacccgtcgtccctcacgccctccaaccaacgggcccacgtccggtccttcccccgtggccctacccctccctaccaaacgacgccaaccgtcgtcgggggggggccacgacggccggcccgtcgggcgttcggcccgtcggtcgaacgggtacctaccttccctaacttaccggattcggctggacggcgggcctgggcaacgggccggacatgngn

SEQ ID NO: 312807 - DNA, 635 bp, Homo sapiens
  misc_feature: GZ8MTXP01EI75B.52.53.E09.1.454.CMB.2.raw
  modified_base (207)..(207): a, c, t, g, unknown or other
  misc_feature (207)..(207): n is a, c, g, or t
  modified_base (360)..(360): a, c, t, g, unknown or other
  misc_feature (360)..(360): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctgggagtgggtctcaagttctttatggtcggtggtaccanattattatgctgactcgtgaagggccattcaccatctcagagacgagtccaggaacagcctgtttcttcaaatggacagtctgagacctgacgacacggctgtctattactgtgcgagagaacccgagggggcggagcacgccccgtaatcgnggggccaacggggaacccggtcaccgtctcctcgacgccctaccaaccgaacgggccctaagtccgggtcccttccccccgtgggccccaacccctccctacccgaaacgacgccaacccgtcgtcggggggggggccaaccgacggcccgggccccgtcggggccttcggcccgttgggtccgaaacgggtacccttaacttcccttaacgttaccggacttccggccgttggacggccggggctcggggccaaagggccgacgataacggngn

SEQ ID NO: 312808 - DNA, 648 bp, Homo sapiens
  misc_feature: GZ8MTXP01CWUWO.52.53.E09.1.454.CMB.2.raw
  modified_base (250)..(250): a, c, t, g, unknown or other
  misc_feature (250)..(250): n is a, c, g, or t
  modified_base (403)..(403): a, c, t, g, unknown or other
  misc_feature (403)..(403): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagcngcagccagagaacggccctggtacttgagtgaggctacaaacaggtgaagtcggacgacgaccaacgaggacggaacggggggacggtacgtcccgtagacgtacgtcttctcgacgggcgtcccggctcggtgggactgacgcgacctaccncacctactcctaccgacgtcctaccgagtcgtacggaacgggggaccggtaggggttactaaccgttaagttaccgtacggtacaaacgggtacggttagggggaaaccctcggttaagggtccgttaagggtttgggggttcgggttaccggggacgggtaacggggttaacccgttaaagggttcgtaacccggttacgtaacgggttaccgaccggacccgtaacggttcccgttccccggg

SEQ ID NO: 312809 - DNA, 613 bp, Homo sapiens
  misc_feature: GZ8MTXP01AJB23.52.53.E09.1.454.CMB.2.raw
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagttctttatggtcggtggtaccacattattatgctgactccgtgaagggccattcaccatctccagagacgagtccaggaacagccttgtttctcaaatggacagtctgagacctgacgacacggctgtctattactgtgcgagacgaaccgngggggcggagcacgccccgtatcgnggggccaaacggggacccggtcacccgtctcctcacgccctccaaccgaacgggcccagtccgggtcccttcccccgtggacccctacccctccctaccgaacgacgcccaccgtccggtcgggggggggacaccgacggcccgggccccgttggggcctcggcccgtggtccgaaacggtccttaaccttccgtaattaccggattccggcgtggacggttcgggctcgggcaacgggcgacagtaacgngn

SEQ ID NO: 312810 - DNA, 591 bp, Homo sapiens
  misc_feature: GZ8MTXP01DPAC9.52.53.E09.1.454.CMB.2.raw
  modified_base (144)..(144): a, c, t, g, unknown or other
  misc_feature (144)..(144): n is a, c, g, or t
  modified_base (202)..(202): a, c, t, g, unknown or other
  misc_feature (202)..(202): n is a, c, g, or t
  modified_base (354)..(354): a, c, t, g, unknown or other
  misc_feature (354)..(354): n is a, c, g, or t
  modified_base (590)..(591): a, c, t, g, unknown or other
  misc_feature (590)..(591): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccnccaggctccgaggggaagggctggagtgggtctcaagttctttatgtcggtgtaccanatattatgctgactcgtgaaggccattcaccatctcagagacgagtccaggaacagcctgttctacaaatggacagtctgagacctgacgacacggctgtctattactgtgcgagacgaacccgagggggcggagcacgcccccgtaatcgnggggccaaaggggaacccggtcaccgtctcctcacgcctcaaccaacgggcccagtccggtccttcccccgtggaccctacccctccctaccaaacgacgaccaccgtccggtcgggggggggacccacgacggcccgggccccgtcggggccttcggcccgtggtaccaaacggtaccttacgttccctaagttacgacttcgcctggacgcgggcctggcaagggcacataagnn

SEQ ID NO: 312811 - DNA, 662 bp, Homo sapiens
  misc_feature: GZ8MTXP01CAHXK.52.53.E09.1.454.CMB.2.raw
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagctgcagccaggagaacgggccctcggtacttgatggaggctacaacagtgagtggcacgccaacgaggcgggaacggggggtacccgtactccgtaggactccggtaacttccgtcgagggccctccgggctcggtggggactggacgcgtacctacccgtcaccatcctccacgtcctcccgagtccgtagggaacgggaccgggggtaggggtacgtaacgttaacgtttaacgtcggtacgtaacgggtaccggtacgggggaaccctacggtggtaccggttaaggttttcgggggttcgggtttccggggacgggggtaaacgggtaccgttaaacgggttccggacccggttaaccggttacgggtcccgacgggtaccccggaggtccccgttcccggtccccccgg

SEQ ID NO: 312812 - DNA, 581 bp, Homo sapiens
  misc_feature: GZ8MTXP01D3A3Q.52.53.E09.1.454.CMB.2.raw
  modified_base (532)..(532): a, c, t, g, unknown or other
  misc_feature (532)..(532): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccaggtaaggggctggagtgggtctcaagtctttatgtcggtggtaccacatattatgctgactccgtgaagggccattcacatctccagagacgagtccaaggaacagcctgtttcttcaaatggacagtctgagacctgacgacacggctgtctattactgtgcgagacggaacccgagggggcggagcacgccccgtaattcgtcggggccaacggggaacccggtcaccgtcctcctcacgccctccgaccgaacgggcccagtccggtccttcccccgtggaccctacccctcctccaaagacgcacctccgtggggggggccacgacggccggcccgtcgggctcgccgtggtcaaacggtcctacttccgtanacggacttcggctcggacggccgggctcgggacaaggcgcagtaagngn

SEQ ID NO: 312813 - DNA, 589 bp, Homo sapiens
  misc_feature: GZ8MTXP01D1UKZ.52.53.E09.1.454.CMB.2.raw
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgcatcgcatggcatcagctgcagccagagaacggccctggtactgatgagctacaacgagtgagtgcagccacgaggcggagggggaccgtactccgtgactcgtaacttctcgacggccgtccggctcggcgggactgacgcgtacctacctcacctactcctaccacgccctcgagttccgaggaacgggacggggtagggttacgtaacttaacttacgtgtacgacggtacggttcgggactacgttgggcgttaaggtttggggttcggttcggggacgggtaacgggtaccttaagggttcgttaaccgtcgtacgggtaacacggtacccgacgggtccgttcccgtccccgg

SEQ ID NO: 312814 - DNA, 609 bp, Homo sapiens
  misc_feature: GZ8MTXP01AVTXH.52.53.E09.1.454.CMB.2.raw
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagttctttatgtcggtggtaccacatattatgctgactcgtgaaggccattcaccatctcagagacgagtccaaggaacagcctgtttctacaaatggacagtctgacgacctgacgacacggctgtctattactggtgcgagacggaacccggngggggcggancgacgccccgtaattcgcggggaccaacggggacccggtcacccgtctccctcacgccctaccgaaccgaacgggccctacgtccggtcccttccccgtcggccctacccctcctacccgaagacgccaccgtcgtcggggggggcacgacggccggcccgtcgggcctcgccgtcggtaccgaacggtaccttacgttcctaacgttacggacttcgacgtcggacggccgggcgtcgggacgaacgggcgcgagtcgngng

SEQ ID NO: 312815 - DNA, 641 bp, Homo sapiens
  misc_feature: GZ8MTXP01D62QS.52.53.E09.1.454.CMB.2.raw
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaacgggccctcggtacttgatgaggctcaacagtgatggcagccacgaggcggacggggggaccgtactccgtggactcggtccttctcgaggcctccgggctcgtgggactgacgcgctacctcacctatcctcacgtccctcgagtccgtagggacggacggggtaggggtctaacttagttaccgtgtacgtacggtaaccgggttggggaacctacggttcgggcgttaaggggttttgggggttcgggtttcgggggacgggtaaacgggggtaccccgttaaaggggtttccggacccccgggttcgtttaaaccggggtccgtaacccgggaccccggttaagggggtccccttcccgggttcccccccccggg

SEQ ID NO: 312816 - DNA, 566 bp, Homo sapiens
  misc_feature: GZ8MTXP01AL0E0.52.53.E09.1.454.CMB.2.raw
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
  modified_base (419)..(419): a, c, t, g, unknown or other
  misc_feature (419)..(419): n is a, c, g, or t
  modified_base (451)..(451): a, c, t, g, unknown or other
  misc_feature (451)..(451): n is a, c, g, or t
  modified_base (565)..(565): a, c, t, g, unknown or other
  misc_feature (565)..(565): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgagggaagggctggagtgggtctcaagttctttatgtcggtggtaccanatattangctgactccgtgaagggccattcaccatctcagagacgagtccaaggaacagccttgtttctcaaatggacagtctgagacctgacgacacggctgtctattactgtgcgagacgaaccgngggggcgancacgccccgtatcgngggccaagggacccggtcaccgtctcctcacgcctccacgacggcccagtccggtccttccccgnggcccaccctcctaccaagacgcaccgttcgnggggggcacgacgccggcccgtgggcctcgccgtggtcaaacggtaccttacttccctaagttaccgattccgtcgtggacggccgggctcgggcaacgggccacgacgtgcgng

SEQ ID NO: 312817 - DNA, 620 bp, Homo sapiens
  misc_feature: GZ8MTXP01AMK9Q.52.53.E09.1.454.CMB.2.raw
  modified_base (294)..(294): a, c, t, g, unknown or other
  misc_feature (294)..(294): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagctgcagccagaggaacgggccctcggtacttgatgaggctcaacngtgatggcagccagagcggaacggggggacgtacgtcccgtgacgtcgcttcgcgacggtcgtccggctcgtgggactggacgcgtcctaccgtcaccctactcctccacgtccctccgaagtccgtaggaacggggtacggtaagggggtctaaccgttaagttaccgtcggtacgaacgggtacggttacggggaacctacgttggggccttaagggtttgggggtcggttcggggaccggggtaagggttacccgttaaaggttcggaaccccggttcgtaacgggtccgaccggaccccgtaacgggttcccgtcccccggg

SEQ ID NO: 312818 - DNA, 545 bp, Homo sapiens
  misc_feature: GZ8MTXP01BK1SR.52.53.E09.1.454.CMB.2.raw
  modified_base (201)..(201): a, c, t, g, unknown or other
  misc_feature (201)..(201): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccanatattatgctgactccgtgaagggccattcaccatctccagagacgagtcccaggaacagcctgttctcaaatggacagtctgagacctgacgacacggctgtctattactgtgcgagagacccgagggggcggancacgccccgtaatcgnggggccaaggggaacccggtnaccgtcncctcacgcctccaccacggccatcggtccttcccctggccaccctcctccaagacgcacctcgcgggggggcacgacgcggcccgtcggggctcgccgtggtcgaacggtactacgttccctattacgattcgctggcgcggcgtggcgaaggcgcataagngn

SEQ ID NO: 312819 - DNA, 597 bp, Homo sapiens
  misc_feature: GZ8MTXP01A6EEB.52.53.E09.1.454.CMB.2.raw
  modified_base (202)..(202): a, c, t, g, unknown or other
  misc_feature (202)..(202): n is a, c, g, or t
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaagggctggagtgggtctcaagtctttatgtcggtgtaccanatattatgctgactcgtgaagggcattcaccatctcagagacgagtccaggaacagccttgttctacaaatggacagtctgacgacctgacgacacggctgtctattactgtgcgagacgaccgngggggcgagcacgcccgtatcgnggggccaagggaacccggtcacccgtctcctcacgtccctaccgaactaaccgggcccactccgggtcccttcccccgtcggccctaccccgtcctacccgaacgacgccacccgtcgtcgggggggcacgacgccgggcccgtcgggcctcgccgttgggtccgaaacggtaccttaccttcctaacgttacgacgttcgcgtacgggcggccgggacgtgggacgaacgggccgcgagtaagngn

SEQ ID NO: 312820 - DNA, 658 bp, Homo sapiens
  misc_feature: GZ8MTXP01DRCDA.52.53.E09.1.454.CMB.2.raw
  modified_base (250)..(250): a, c, t, g, unknown or other
  misc_feature (250)..(250): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgcatcgcatggcatcagcngcagccagagaacggccctcggtacttgatgaggctacaacagtgatggcagccaagaggcggacgggggacgtatcccgtgtactcgcttcgtcgacgggcctccgggctcggtcgggactgacgtcgtacctaccgtccacctactcctaccgacgccccttaccgaagtcgtacgggaacgggggtaaccggtagggggtacaacgtttaacttaccgtggtaccgaaacggtccgggttacgggaccctaacgggttgggttaaccgttaagggttttcgggggttacgggtttaccggggaccgggggtaacgggttacccggttaaaagggttcccggtaaccgggttacccgtaacgggtaccgaccgggttacccggtaaacggttccgttccccccggg

SEQ ID NO: 312821 - DNA, 559 bp, Homo sapiens
  misc_feature: GZ8MTXP01CQW38.52.53.E09.1.454.CMB.2.raw
  modified_base (356)..(356): a, c, t, g, unknown or other
  misc_feature (356)..(356): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattatgctgactccgtgaagggccattcaccatctccagagacgagtccaggaacagcctgtttctacaaatggacagtctgagacctgacgacacggctgtctattactgtgcgagacgaacccgagggggcggagcacgcccctaagtcgnggggccaacggggacccgtcaccgtcncctnacgcctccaccgaggcccatcggtctccccgtggccaccctcctccaagcgccaccgtcgtcggggggggccacgacgccggccctggggcctcggccgtggtaccgaaaggccttacctctaagttccgattccgactggacggttcgggctgggcaaggcgcgatggngn

SEQ ID NO: 312822 - DNA, 557 bp, Homo sapiens
  misc_feature: GZ8MTXP01A2QBM.52.53.E09.1.454.CMB.2.raw
  modified_base (234)..(234): a, c, t, g, unknown or other
  misc_feature (234)..(234): n is a, c, g, or t
  modified_base (340)..(340): a, c, t, g, unknown or other
  misc_feature (340)..(340): n is a, c, g, or t
  modified_base (383)..(383): a, c, t, g, unknown or other
  misc_feature (383)..(383): n is a, c, g, or t
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgcacagggtctctctcccagcctgtgctgactcaatccgccctctgcctctcgcctcccgtgggacnccgtcggtcaagcctcactgccactctgagcaggtggcactacacctacgccatcgcatgcatcagctgcagccagagacggcctgtactgatgagctacaaacgngtgatcggcacgacctacgagggcgagggggacgtactcccgngactcgcttcgtcgcggtccgtccgctcgtcgggacgtcgacgcgcctaacctccacctactcctccacgtccctccgaagtccgtaggacgggaccggttaaggtacgtaacttacgttaccgttggttaaccgaggtaaccgttcgggaaccgaggtccggttcgtttgggg

SEQ ID NO: 312823 - DNA, 673 bp, Homo sapiens
  misc_feature: GZ8MTXP01EV8HM.52.53.E09.1.454.CMB.2.raw
  modified_base (252)..(252): a, c, t, g, unknown or other
  misc_feature (252)..(252): n is a, c, g, or t
  modified_base (369)..(369): a, c, t, g, unknown or other
  misc_feature (369)..(369): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgccctcccgtgggagcctcggtcaagctcacctgcactctgagcagtggcactacacctacgccatcgcatggcatcagcngcagccaagacggaacggccctacggtacttgatgaggctacaacagtgatggcagccacgaggcggacgggggacgtactcccgtgacgtcgcttcgtcgacggcctccggctcgngggactgacgtcgctaacctcacctactcctaccgacgtccctacgtagtacgtacgggaacggggtaccgggtaaggggtactaacgttaacgttaaccgtcggttaacgaacgggtacgggttacgggaaacctaaccggttggggtaaccgtttaaggggttttcggggggttaccggtttccgggggaacgggggtaaccggggttaaacccggttaacgggtttaccgggaaccccggttaccggtaacggggttcccaacgggttaccccgtaaacgggttccccgttaacccccggg

SEQ ID NO: 312824 - DNA, 529 bp, Homo sapiens
  misc_feature: GZ8MTXP01ALTMX.52.53.E09.1.454.CMB.2.raw
  modified_base (256)..(256): a, c, t, g, unknown or other
  misc_feature (256)..(256): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
  modified_base (508)..(508): a, c, t, g, unknown or other
  misc_feature (508)..(508): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttatgtcggtgtaccacatattatgctgactcgtgaaggccattcacatctcagagacgagtccaggaacngcctgtttctacaaatggacagtctgagcctgacgacacggctgtctattacngtgcgagacgaccgngggggcgagcacgcccgtatcgngggccaagggacccgtnaccgtcncncagccncacacgccatcgtcctcccgngccacctccncaacgcgcacctcgacggggggcacgcgccggccgtcggctcgccgtggtacaacggtcctacttcctaagttcgacttcgccgtggacggcgggcgnggacgaacggcgacagtgngn

SEQ ID NO: 312825 - DNA, 586 bp, Homo sapiens
  misc_feature: GZ8MTXP01DOXBI.52.53.E09.1.454.CMB.2.raw
  modified_base (285)..(285): a, c, t, g, unknown or other
  misc_feature (285)..(285): n is a, c, g, or t
tcagcgcagtacgacacgaccggtgctcgatttagagagagtgtgttgggtttgggggagctctggggagtctgcaccatggcttggacccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagcagagaggcctcggtactgatgaggctcaanagtgatggcagccacgaggcgaggggggaccgtactccgtgactcgcttctcgaggccgtccggctcgtgggactgacgcgactacctcaccattcctccgacgtccctaccgacgtccgtagggacgggtacggggagggttcgaacttagttacgtgtcgaggaccggttggacctacgtggcgttaaggttttggggttggttacgggcgggaacggggtacccgttaaagggttccggttacccggttccgtaagggtccgaacggtcccgaacgggtcccgttcccggtcccccgg

SEQ ID NO: 312826 - DNA, 511 bp, Homo sapiens
  misc_feature: GZ8MTXP01BMFV5.52.53.E09.1.454.CMB.2.raw
  modified_base (259)..(259): a, c, t, g, unknown or other
  misc_feature (259)..(259): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggtaaggggctggagtgggtctcaagttctttatgtcggtggtaccacatattatgctgactcgtgaaggccattcaccatctcagagacgagtccaaggacngcctgtttctacaaatggacagtctgagacctgacgacacggctgtctattactgtgcgagacgaccgngggggcgancacgcccgtatcgnggcaagggaccgnccgtcncnagcctcacacgcatcgtctcccngccacctcncagcncactcgngggggcacgcgccgccgtggctcgaccgtggtccaaggtacctctcctattacgacttcgcgtcgacggcgggcgtggacaagggccnagtgngn

SEQ ID NO: 312827 - DNA, 567 bp, Homo sapiens
  misc_feature: GZ8MTXP01AG5NR.52.53.E09.1.454.CMB.2.raw
  modified_base (192)..(192): a, c, t, g, unknown or other
  misc_feature (192)..(192): n is a, c, g, or t
  modified_base (205)..(205): a, c, t, g, unknown or other
  misc_feature (205)..(205): n is a, c, g, or t
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (381)..(381): a, c, t, g, unknown or other
  misc_feature (381)..(381): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctgggagtgggtctcaagttctttangtcggtgtaccanatattangctgactcgtgaagggccattcaccatcncagagacgatccaggacagcctgttctacaaatggacagtctgacgacctgacgacacggctgtctattacngtncgagacgaccgagggggcgancacgcccgtatcgcgggccaacggggacccggtcaccgtctccncacgccctacaaccgacgggcccacgtccggtccttccccgtcggaccctaccccgtcctacccgaaacgcgccaccgtcggtacgggggggcacgcgccggccgtgggctcgccgtggtacacggtacttacgttcctattacgtagttcgcgtggacggcgggctggcgaacggcgcagtgngn

SEQ ID NO: 312828 - DNA, 664 bp, Homo sapiens
  misc_feature: GZ8MTXP01CALC7.52.53.E09.1.454.CMB.2.raw
  modified_base (316)..(316): a, c, t, g, unknown or other
  misc_feature (316)..(316): n is a, c, g, or t
  modified_base (368)..(368): a, c, t, g, unknown or other
  misc_feature (368)..(368): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagcttgggttttccttgttgcttaattttaaaaggtgtccagtgtggagtgcaggtggtggagtcgtgggggagcttggtccagccgtggtcggttccctgagactctcctgtgcagcctctggtactctccgtcagtagacaaactacatgagcgtcgggtccnccgaggctcggagggggagggctgggagtcgggtctcgtaagttccctttanggttcggtacggtaccaaactattgttatcgctcgaccgtccggtagggaacgggccctatccaccatccacgagtacgacgacgtccaaggaactacgtcccgttagggttttacctaagaaaagttcgggaactagttccgtaaggacgtaccgtaggaaaccgacaccggggtcttacggttacttaacgttacgtgggtcgaacccgggaaggaacccgggaaaccccggggagggggggggccggacgaccccgggaaccggtaacccccggtttaaacggttcccggggg

SEQ ID NO: 312829 - DNA, 610 bp, Homo sapiens
  misc_feature: GZ8MTXP01A5QDC.52.53.E09.1.454.CMB.2.raw
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacactacgcatcgcatggcatcagcngcagccagagaacggccctggtacttgatgaggctcaacngtgatggcagccagacggcgacgggggacgtactcccgtgacgtcgcttcgtcgacgggtcctccgggtctcgtggggacctggacgtccgactacctccacactcctaccacgtccctcgaacgtctacggacgggggtacggtaggggtcaacgttacttacgtgttacgacggtacggtcgggactaccgtgggtaacttagggttttcggggtcggtttccggggacggggtaacgggttacccgttagggttccggtaacccggttccgtaacgggttccgacggttaccccgaacgggttccgttaacccccggg

SEQ ID NO: 312830 - DNA, 623 bp, Homo sapiens
  misc_feature: GZ8MTXP01AVZEI.52.53.E09.1.454.CMB.2.raw
tcagcgcagtacgacacgaccggtgctcgatttagagagagtgtgttgggtttgggggctgtgggtccaggaggcagaactctgggtgtctcaccatggcctggatccctctacttctccccctcctcactctctgcacaggctctgaggcctcctatgagctgacacagccaccctggtgtctgtgtcctcaggacagacggccaggatcacctgctctggagatgctattgaccaaagcaatatgcttactgacagcagaacgcccgcacggcccctgtctgtactttattaataaagtactttgagacgccctacgacggacccctgacgcgtacttctcgtcggcctaccgaagtcctcgacgaccgaaaccaaacgtacggtaccgtacgtttacgaaccctagttaccgaagggttacgggaacgttacccgaagggaccgaagggaacgggaaccgagggtacctagtaaacccgttatttaacgttcggttacaacgttacaacgttaccaagaaccgagccgtaaggtcggctaacgtttagttcggtacgttacgttcggggacgttacggaaccttaacgtcgtacgtccgtagcgacgtcccgaaggtccc

SEQ ID NO: 312831 - DNA, 573 bp, Homo sapiens
  misc_feature: GZ8MTXP01AP7VQ.52.53.E09.1.454.CMB.2.raw
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaaggcctggtactgatgaggctcaacagtgatggcacgccacaggcgaggggggaccgtactccgtgactcggtacttctcgacgggtcctccgggctcgtggggactggacgcgcttacccncacactccncacgtcctacgtagtcgaggacggacggggtaggtgtacttagttacgtgtacgaggtacggtcggactacggtcggtcgttaaggttcgggttcggtcgggacgggtaacgggtaacgttacggttccggaccgttcgtacggtccgacggacccgttacggtccgttcccggtccccg

SEQ ID NO: 312832 - DNA, 646 bp, Homo sapiens
  misc_feature: GZ8MTXP01DQ9NV.52.53.E09.1.454.CMB.2.raw
  modified_base (186)..(186): a, c, t, g, unknown or other
  misc_feature (186)..(186): n is a, c, g, or t
  modified_base (251)..(251): a, c, t, g, unknown or other
  misc_feature (251)..(251): n is a, c, g, or t
  modified_base (309)..(309): a, c, t, g, unknown or other
  misc_feature (309)..(309): n is a, c, g, or t
  modified_base (399)..(399): a, c, t, g, unknown or other
  misc_feature (399)..(399): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgccctccctgggacncctcggtcaagctcacctgcactctgagcagtggcactacacctacgcatcgcatggcatcagcngcagccagagaacggcctggtactgatgaggctacaacagtgagtggcacgccaacgnggacggacgggggacgtactcccgtgacgtcgtcttcgccgacgggtccctccgggcttcggtacgggtactgggacgccgccttaaccncctaacctactacctccaacgtccctccgagtcgtaggacgggggaacggtagggtacgtaccttagttaaccgtggttacgaacggtcgggtacgggtacctaaccggttggggtaacctttcggggtttgggggttccggggtttaacgggaaccgggggtacgggaaacgttacggggttaccgtaaccggtacgtaacgggtccgacgggttaccccgtaagggttcccgtttaacccccggg

SEQ ID NO: 312833 - DNA, 517 bp, Homo sapiens
  misc_feature: GZ8MTXP01ATD4H.52.53.E09.1.454.CMB.2.raw
tcagcgcagtacgacacgaccggtgctcgatttagagagagtgtgttgggtttgggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgctattgaccaaagcaatatgcttactggaccagcagaacgcccggcacggccctgtctgctttaattataagactttgagacgccctcgacggaccctgacgcgtacttctcgtggctccaagctcacgcgaacacagtcacgttacgacatcaggtcggagtccgagcgaggaggacgagctagacctattctgtcagtcatgaagacagcaggtcgcctaattattggtcttagttcgggacggacggacaacgtcgaccgtcgtacggtcacgtcccgaaggtccc

SEQ ID NO: 312834 - DNA, 562 bp, Homo sapiens
  misc_feature: GZ8MTXP01AO0MT.52.53.E09.1.454.CMB.2.raw
  modified_base (183)..(183): a, c, t, g, unknown or other
  misc_feature (183)..(183): n is a, c, g, or t
tcagcgcagtacgacacgaccggtgctcgatttagagagagtgtgttgggtttgggggctgtgggtccaggaggcagaactctgggtgtctcaccatggcctggatccctctacttcctccccctcctcactctctgcacaggctctgaggcctcctatgagctgacacagccaccctcggtntctgtgtcctcaggacagacggccaggatcacctgctctggagatgcattgaccaaagcaatatgcttactggaccagcagaacgcccggccacggcccctgtcttgtctttaatttataaagtactttgacgacgccctacgacgggacccctgacgcgtacttctcgtgcctccaagcctcacgccgaacaacgagtcacgttacgaccatcgaggtcggacgtccgaggcaaggacggacgagctagacttagtctgtcagtcatcgagacagtcagtcgctaacttgttggtacgttcgtccggggaacggacgggaaccttaaacggtcggacccgttaaccgtacgggtaccgaccgtcccgaacgggtcccg

SEQ ID NO: 312835 - DNA, 691 bp, Homo sapiens
  misc_feature: GZ8MTXP01AU0XM.52.53.E09.1.454.CMB.2.raw
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctcgcctccctgggacgcctcggtcaagctcacctgcactctgagcagtggcactacacctacgcatcgcatgcatcagctgcacgcaggagaacgggtccctcggtactgagtgacggctacaacgagtgagtggacacgccacgaggcggaaggggggtaccgtacgtccgtagtacgtccgtccttccgtcgacgggtcccgtccgggcctcggtacggggactcgggacgccgtacctaccctccaacctcttaccctccgacgtccccttaccgagttccgacgggtacgggaacggggtaggggttaactaacgtttaacgttaacgtcggtacgaacggtacgggtcggggtaaactaccggttgggaccgttaagggttttcgggggttcgggtttccgggacggggtaaacggggttaaccgttaagggttcccgggttaacccggttaaccgggttacggtccggaaccgggtacccggttaacgggtccccgttcccggttcccccccggg

SEQ ID NO: 312836 - DNA, 628 bp, Homo sapiens
  misc_feature: GZ8MTXP01BKF3M.52.53.E09.1.454.CMB.2.raw
  modified_base (205)..(205): a, c, t, g, unknown or other
  misc_feature (205)..(205): n is a, c, g, or t
  modified_base (262)..(262): a, c, t, g, unknown or other
  misc_feature (262)..(262): n is a, c, g, or t
  modified_base (333)..(333): a, c, t, g, unknown or other
  misc_feature (333)..(333): n is a, c, g, or t
  modified_base (358)..(358): a, c, t, g, unknown or other
  misc_feature (358)..(358): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagttctttatgtcggtggtaccanatattatgctgactccgtgaagggccattcaccatctccagagacagtccaggaacngccttgtttctcaaatggacagtctgagacctgacgacacggctgtctattactgtgcgagacgaacccgngggggcggagcacgccccgtatcgnggggcccaaggggacccggtcaccgtctcctcacgccctacaaccgaacgggcccacgttccggtccttcccccgtggacccctaccccgtcctaccgaaacgacgccaccgttccggcgggggggggaccaccggacggcccgggtccccgtggggccgttcggcccgttgggtaccaacgggtacctttaaccttcctaacttacggtacgttccgtacgtggacgggccggggttacgtcgggaccgaacgggcgacttaagtgngn

SEQ ID NO: 312837 - DNA, 522 bp, Homo sapiens
  misc_feature: GZ8MTXP01EUA01.52.53.E09.1.454.CMB.2.raw
  modified_base (183)..(183): a, c, t, g, unknown or other
  misc_feature (183)..(183): n is a, c, g, or t
  modified_base (285)..(285): a, c, t, g, unknown or other
  misc_feature (285)..(285): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (415)..(415): a, c, t, g, unknown or other
  misc_feature (415)..(415): n is a, c, g, or t
tcagcgcagtacgacacgaccggtgctcgatttagagagagtgtgttgggtttgggagagctctgggagtctgcaccatggcttggaccccactcctcttcctcaccctcctcctccactgcacagggtctctctcacagcctgtgctgactcaatcgccctctgcctctgcctccctgggancctcggtcaagctcacctgcactctgagcagtggcactacacctacgccatcgcatggcatcagctgcagccagagaaggcctggtactgatgagctcaacngtgatggcagccaacagccgaggggggactatcccctggaaatccgcttcgtcgaaggcctccgggtctcgtgggactgacgcgcttaccncaaccntctccagcctacagtctggggacgacgagggtnactagtctagtcagtacgtggacacgtggcttaggttgggttcgttcggcgggttaggaccttaaggttcgaaccgtcctaagggtccagccccgttaagggccccg

SEQ ID NO: 312838 - DNA, 635 bp, Homo sapiens
  misc_feature: GZ8MTXP01CSXOB.52.53.E09.1.454.CMB.2.raw
  modified_base (187)..(187): a, c, t, g, unknown or other
  misc_feature (187)..(187): n is a, c, g, or t
  modified_base (253)..(253): a, c, t, g, unknown or other
  misc_feature (253)..(253): n is a, c, g, or t
  modified_base (527)..(527): a, c, t, g, unknown or other
  misc_feature (527)..(527): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgccctcccgtgggancctcggtcaagctcacctgcactctgagcagtggcactacacctacgccatcgcatggcatcagcngcagccagagaacggcctggtacttgatgaggctacgaacgagtgagtcggcacgacccgaacgaggacgggaaccggggggtaaccggtactcccgtaggacgttcccggtcttccgtcgtacgggtcccgttccgggcgttcggtacggggactcggacgtccgtacccttacctaccaaaccctactttccctaccgaaccgtcccttaccgaagttcccgtagggaacgggggtaaccggtaggggttactaaaccgttagttaacccgngtaccgagggtacgtgggacctacggtggtctaggttgggtcgttcgggacgggagaccgttagttcggaaccgtacgtaacggcgacgaccgtaacggcgtccccgg

SEQ ID NO: 312839 - DNA, 552 bp, Homo sapiens
  misc_feature: GZ8MTXP01AB8WM.52.53.E09.1.454.CMB.2.raw
  modified_base (209)..(209): a, c, t, g, unknown or other
  misc_feature (209)..(209): n is a, c, g, or t
  modified_base (231)..(231): a, c, t, g, unknown or other
  misc_feature (231)..(231): n is a, c, g, or t
  modified_base (285)..(285): a, c, t, g, unknown or other
  misc_feature (285)..(285): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (354)..(354): a, c, t, g, unknown or other
  misc_feature (354)..(354): n is a, c, g, or t
  modified_base (401)..(401): a, c, t, g, unknown or other
  misc_feature (401)..(401): n is a, c, g, or t
  modified_base (431)..(431): a, c, t, g, unknown or other
  misc_feature (431)..(431): n is a, c, g, or t
tcagcgcagtacgacacgaccggtgctcgatttagagagagtgtgttgggtttgggcacgaccggtgctcgatttagagagagtgtgttgggtttgggagcagagctctggggagtctgcaccatggcttggaccccactcctcttcctcaccctcctcctccactgcacagggtctctctcccagcctgtgctgactcaatcgccctntgcctctcgcctccctgggacncctcggtcaagctcacctgcactctgagcagtggcactacacctacgccatcgnatggcagtcagctgcagccagagacggcctgtactgatgagctnaaaacngtgatgggcacgcctaagngtcggagggggactactcccgtagctcgcttcgacgcggccgtccgntcgtaggacgtggacgtccgccttaacccncacctactccgaccgtacgtccctcgtagtcgtagggacgggtacggagggtacgtaacttacgttcgttacggtaacgaacggtaacggtacgggacgttacggtcggttaacgttaagg

SEQ ID NO: 312840 - DNA, 630 bp, Homo sapiens
  misc_feature: GZ8MTXP01AISDL.52.53.E09.1.454.CMB.2.raw
  modified_base (183)..(183): a, c, t, g, unknown or other
  misc_feature (183)..(183): n is a, c, g, or t
  modified_base (208)..(208): a, c, t, g, unknown or other
  misc_feature (208)..(208): n is a, c, g, or t
  modified_base (383)..(383): a, c, t, g, unknown or other
  misc_feature (383)..(383): n is a, c, g, or t
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggancctcggtcaagctcacctgcactcngagcagtgggcactacacctacgccatcgcatggcatcagctgcagccagagaacggcctcggtacttgatgacggctacaacagtagagtggcagccacgaggcggaggggggacccgtatccgtgactcgtcttcgcgacgggcctccggctcgtgggactggagcgcctacnccaccactcctccagtccctcgacgttcacggacgggaaccggggtaggggtcgtaaccgttagttaccgtggttaccgaggtaaaccggttgggggaccctaacggttggggcccttaagggttttcggggttacgggtttccgggggacgggtaaacgggggtaaccccttaaaggggtttccgaacccggttccggtagggtccaccgggaccccgagggtcccgttccccggttccccccggg

SEQ ID NO: 312841 - DNA, 726 bp, Homo sapiens
  misc_feature: GZ8MTXP01EZSM4.52.53.E09.1.454.CMB.2.raw
tcagcgcagtacgacacgaccggtgctcgatttagagagagtgtgttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgaccaaagcaaatatggttatggtaccagcagaggccaggccacggcccccttagtggtgatataataaggaccatagacggacggcccctcgagggactccctgacgcgtacttctcgtggcctccctccctcgaacgggaacaacgacgtctacgttacgatccagttaccgaagggttcggggaacggttcccgggggacgtaacggggaacgggaaccgggaagggtacccgttaggtaaacccgtttaagttaaccgttacggggtaactaaacgttacccaaaacgaacggtaaacccgtaaggttaacgggttagggtttaacctttaaagtacggtggttacgtaacgggtttacggggaccgggggaaaccgggggttaacccaaaggttcccgttaccggttacccggttacccggttaacgggtacccaaccgggtaacccccgtaagggccccgttccccggttccccccgttaacccgggg

SEQ ID NO: 312842 - DNA, 554 bp, Homo sapiens
  misc_feature: GZ8MTXP01EJQVI.52.53.E09.1.454.CMB.2.raw
  modified_base (212)..(212): a, c, t, g, unknown or other
  misc_feature (212)..(212): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (264)..(265): a, c, t, g, unknown or other
  misc_feature (264)..(265): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (398)..(399): a, c, t, g, unknown or other
  misc_feature (398)..(399): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaagggctggagtgggtctcaagttctttatggtcggtggtaccacattattangctgactccgtgaaggccattcacatctcaganagacggacaggacngtctnnatgtacagctgagcngacgacacgacagtctntntntntgngngacnggaccggacggacggaggccgacgtaccgacggcccgtacggtacccgggtcggaccggtaccggtacccgtaccgacgtcctccnnccacgccgacgccgcgtcccgtcgtcccgtccgtccctcccgtccgacccgaccgaccgtaccgtaccggaccgtacggcgcggccgccggccgccggtccgtcgttccgttcgaccgtaacgtaccgtaacgtactacttacctccgttcgtcg

SEQ ID NO: 312843 - DNA, 669 bp, Homo sapiens
  misc_feature: GZ8MTXP01DFX0S.52.53.E09.1.454.CMB.2.raw
  modified_base (241)..(241): a, c, t, g, unknown or other
  misc_feature (241)..(241): n is a, c, g, or t
  modified_base (383)..(383): a, c, t, g, unknown or other
  misc_feature (383)..(383): n is a, c, g, or t
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctcccgtgggagcctcggtcaagcctcacctgcactctgagcagtggccactacacctacgccatcgnagtggcatcagctgacacgccgaaggacggaaccgggccctcggtacttgatggacggtctacaacgtagtgagtcggacacgaccgacggacggcggggaacgggggtacccgtacctaccggtgtacgtccgtaccttcncggacggtcccgtccggacgtcggcgggtactggacnccgtctaccncactcgtacctccgactccgtccgtagtccgtacgggaacgggtacgggggtaacgggttacgtaaaccgtttacgttacgtcgttacggaacggtacgggtacggggtacctagggtcgggttacgttaaggggtttcggggttgggtaccggggacgggtaacggtaccgttaaggttccgggttaccgttccggtacggcccgacggcccgttacggtcccgttccgttcccccgg

SEQ ID NO: 312844 - DNA, 653 bp, Homo sapiens
  misc_feature: GZ8MTXP01BCEYB.52.53.E09.1.454.CMB.2.raw
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (484)..(484): a, c, t, g, unknown or other
  misc_feature (484)..(484): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcaggtcggaccactaccacgtacgacatcgntagcgacatcgacgcngacgacgaccgaaggaacggaaccggtccccgttaggtacttaggagtaggacggtacctaaccgaaacgtaggtacggtacgtcggacgacgacccaacggacggtacgggggaacgggggtacgtacctcccgtagtacgtccgtcgttccgacggacgtcccgtccggtctcgggtaggacgtagcgtcctacccttaccaccactaccgttccaaccgccnccgtacgtagtcgtaacgggacggggtaacggtacggtactaacttacgtcgcgtacgacggtacggtacgtacgtggtcgtaagtttgggttcgggtcggacgggacggaacggttacgttggttaccgtaaccgtaggtaacgacgaccgacgtcgttcccgtcccg

SEQ ID NO: 312845 - DNA, 639 bp, Homo sapiens
  misc_feature: GZ8MTXP01AMWAP.52.53.E09.1.454.CMB.2.raw
tcagcgcagtacgacacgaccggtgctcgatttagagagagtgtgttgggtttgggggctgtgggtccaggaggcagaactctgggtgtctcaccatggcctggatccctctacttcctccccctcctcactctctgcacaggctctgaggcctcctatgagctgacacagccaccctggtgtctgtgtcctcaggacagacggccaggatcacctgctctggagatgcattgaccaaagcaatatgcttactggtaccagcagaacgcccggccacggcccctgtcttgtactttatttaataaagtactttgagcgtcccctacgacggacccctggacgccgtacttccgtcgtcggtcctccgaagcctcgagacccgaacaacgtacgtacctacgttacgaaccctagttaccgaaggttcgggacgttacccgagggacgaacgggaacgggacggagggaccttaggtaacctttagtttaacgtggtacccaaggttccgaacgttacaacggacacggaccgaggttcggctaacgtttagcggttacgttagttaccggggcggttaacggacccttaaacggtcgtaacccgtcgttacgggcaccggaaccccgttaaggtccccg

SEQ ID NO: 312846 - DNA, 607 bp, Homo sapiens
  misc_feature: GZ8MTXP01AXONK.52.53.E09.1.454.CMB.2.raw
  modified_base (145)..(145): a, c, t, g, unknown or other
  misc_feature (145)..(145): n is a, c, g, or t
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccnccaggctccgagggaagggctggagtgggtctcaagtctttangtcggtgtaccanatattangctgactcgtgaaggcattcacatcncagagacgatcaggacagtcttgttctacaaagtggactagtctaggaacgtaccctagaaccgacgacgggtctgttaccttaattacgtgtggacgagacggaacccggngggggcgganccgaccgtaccccgtaagttcggcggggaccaaacggggacccggtcaccgtctcctcacgcctaccgaccgacgggcccacgtccggttccctcccccgtggaccccaccctccaccgaagaccgccgtaccgtcggcggggggaccaacgcgcccggccgtggcctcgccgtggactaacggtcctacgtccctagacgtacttcgacgtggacgggcggttcgcggaccgaaggccgattagngngng

SEQ ID NO: 312847 - DNA, 581 bp, Homo sapiens
  misc_feature: GZ8MTXP01B1M16.52.53.E09.1.454.CMB.2.raw
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (259)..(259): a, c, t, g, unknown or other
  misc_feature (259)..(259): n is a, c, g, or t
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttatgtcggtggtaccanatattangctgactcgtgaaggccattcaccatctccagagacgagtccaggaacngccttgttctacaaatggacagtctagacgacctgacgacacggtctgtctattactgtgcgagacgaccgagggggcgancaccgccccgtatcgcggggaccaacggggacccggtnacccgtctccncacgccctacgaccgacggccacgtcggtccttccccgtggaccctacccctcctaccgaacgacgccaccgtcggtcgggggggacacggacgccggcccgtgggcctcgccgtcgtacgaacggtaccttacttcctaacttacgacgttcgcgtggacggcgggcgtggaccgaaggcgagataagngn

SEQ ID NO: 312848 - DNA, 666 bp, Homo sapiens
  misc_feature: GZ8MTXP01EP9VR.52.53.E09.1.454.CMB.2.raw
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (236)..(236): a, c, t, g, unknown or other
  misc_feature (236)..(236): n is a, c, g, or t
  modified_base (267)..(267): a, c, t, g, unknown or other
  misc_feature (267)..(267): n is a, c, g, or t
  modified_base (506)..(506): a, c, t, g, unknown or other
  misc_feature (506)..(506): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaaggggaagggctggagtgggtctcaagttctttatgtcggtgtaccanatattangctgactcgtgaaggcatcacatcncagagacgatccaggacagtcctgtttctanaaagtgacagtctggacacctgacgacacggtctgttactattacgtggtacgacgaaggaaccgaaccggaggggggcgactcgaacccggtacccccgttaaagttcggacgggggaccctaaaacgggggaaccccgggttcacccgtcgtccctcgaaccgccctaccgaaccgaacgggtccctagttcccggtccttccccgtaggacccctaacccctcctaccgaacgacnccgtaccgtggacggggggcaaccggacggccccggccgtggggccttcgccgttaggtaccaacggtaccttaccgttaacttaacgaacgcgttcggcgtcgggacggttcccggggagttaaccggggacaaacggggtcctacgaagtaacgngng

SEQ ID NO: 312849 - DNA, 578 bp, Homo sapiens
  misc_feature: GZ8MTXP01B9OQB.52.53.E09.1.454.CMB.2.raw
  modified_base (290)..(290): a, c, t, g, unknown or other
  misc_feature (290)..(290): n is a, c, g, or t
  modified_base (470)..(470): a, c, t, g, unknown or other
  misc_feature (470)..(470): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacaggtctctctcccagcctgtgctgactcaatcgccctctgcctctgcctccctgggagcctcggtcaagctcacctgcactctgagcagtggcactacacctacgccatcgcatggcatcagctgcagccagagaacggccctggtactgatgaggctacaacngtgatggcagccagcgcgacgggggacgtactccgtgactcgcttcgcgacggctccggctcgtcgggactgacgccgtcctacctccacctatcccgtccacggtccctacgacgtctacggacggggacggtaggggtctaacgttatacgtcgtacgagtacggtacggactacggnggtcttaaggttggggtcgttcggggaacgggtcgggttaaccgttaggttacggaacccggttccgtaagggtcccgacggacccgtaaacgggccgtaaccccggg

SEQ ID NO: 312850 - DNA, 617 bp, Homo sapiens
  misc_feature: GZ8MTXP01CZFGI.52.53.E09.1.454.CMB.2.raw
  modified_base (184)..(184): a, c, t, g, unknown or other
  misc_feature (184)..(184): n is a, c, g, or t
  modified_base (250)..(250): a, c, t, g, unknown or other
  misc_feature (250)..(250): n is a, c, g, or t
  modified_base (401)..(401): a, c, t, g, unknown or other
  misc_feature (401)..(401): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggancctcggtcaagctcacctgcactctgagcagtggcactacacctacgccatcgcatggcatcagcngcagccaagacggaacggcccctggtacttgatgaggctacaaacagtgagtggacagccaacgaggacggaacggggggacggtacgtcccgtagacgtccgtcttcgtacgacggtccgtccggctcgtcggggactgacgcgctaccncacatcctacacgccctacagttccagggacggggtaacggaggggtactacgttacgttaacgtgtaccgaaagggtacggttacgggaccaccggttgggaaccgtttaagggtttgggggtcggttcggggaccggggtacgggttaaccgttaagggttccggtaacccggtcgttaacggacgacggaccccgaaggttcccgttccccgg

SEQ ID NO: 312851 - DNA, 601 bp, Homo sapiens
  misc_feature: GZ8MTXP01DI1IY.52.53.E09.1.454.CMB.2.raw
  modified_base (227)..(227): a, c, t, g, unknown or other
  misc_feature (227)..(227): n is a, c, g, or t
tcagcgcagtacgacacgaccggtgctcgatttagagagagtgtgttgggtttgggcacgaccggtgctcgatttagagagagtgtgttgggtttgggagcagagctctggggagtctgcaccatggcttggaccccactcctcttcctcaccctcctcctccactgcacagggtctctctcccagcctgtgctgactcaatcgcctctgcctctgcctccctggancctcggtcaagctcacctgcactctgagcagtggcactacacctacgccatcgcatggcatcagctgcacgccgaggtacggaaacgggtccctacggtacgttgataggacggacctacgaaaacgaaggttgagtcgggaccacgaccacgacgggacgggacggggggtacttactcccgagtacgtcgtcgtttcgcgacggtctcccggctaacggtcggggaacttcggacggtccgtccttaaccgtccaacctcgtcctccacggtccctcccgagttccgtgggaacgggccggttaggggtactaccgttaaagtttcgacgtccgaaggtccggtagggaccttagtcggttaacgtttgggg

SEQ ID NO: 312852 - DNA, 604 bp, Homo sapiens
  misc_feature: GZ8MTXP01D50PC.52.53.E09.1.454.CMB.2.raw
  modified_base (212)..(212): a, c, t, g, unknown or other
  misc_feature (212)..(212): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (597)..(597): a, c, t, g, unknown or other
  misc_feature (597)..(597): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagttctttatggtcggtggtaccacatattangctgactccgtgaagggccattcaccatctccagagacgagtcccaaggaacagccttgtttctacaaatggacagtctgagacctgacgacacggntgtctaattcnggtgcgagacgaccgngggggcgancacgccctatcgnggggccaagggacccgtnaccgtctcctcacgccctaccgaaccgacgggccctacgtccggtcccttcccccgtggacccacccctccctacccaaacgacgaccaacccgtccggtacgggggggggaccacgacggcccgggcccgtggggcctcggaccgtgggtaccgaaacggtcctacttaacctaagttacgacttcgacgtggacggttcgggcgtgggacgaaggccgngatgngn

SEQ ID NO: 312853 - DNA, 622 bp, Homo sapiens
  misc_feature: GZ8MTXP01AOW02.52.53.E09.1.454.CMB.2.raw
  modified_base (251)..(251): a, c, t, g, unknown or other
  misc_feature (251)..(251): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagcngcagccagagaacgggccctggtacttgatgaggctcaacagtgagtggcagccacgaggcggacggggggacgtatcccgtgatcgcttctcgacggctccggctcgtgggactgacgcgctacctcacactcctccacgccctccgagttcgaggacgggggtacgtaaggggtcgtaaccttagttaacgtcggtacgtacgggacgggttgggggaacctcggtcgggtaacgttaagggttttcgggggtcggtttaccgggggacggggtaacggggttacccgttaagggtttcccggaacccgggttccgtaacgggttcccgaaccgggttaccccggtaaacgggttcccgttcccccggg

SEQ ID NO: 312854 - DNA, 626 bp, Homo sapiens
  misc_feature: GZ8MTXP01EZQ1I.52.53.E09.1.454.CMB.2.raw
  modified_base (484)..(484): a, c, t, g, unknown or other
  misc_feature (484)..(484): n is a, c, g, or t
  modified_base (567)..(567): a, c, t, g, unknown or other
  misc_feature (567)..(567): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttccttgttgcttattttaaaggtgtccagtgtggagtgcaggtggtggagtcgtgggggagtcttggtccagtcccgtgggttcggttcccctggacgtaccttctccgtgtcgcacggtcctcgtggtacttccgtcccgtacagtacgactaaactacagttgagtcgtcgggtcccgccgaggcctccggaggggaacgggctgggagttgggctacgtaagttcctttagtggtcggtagtacccaactattcttatgctcgacctcggtaggaacgggcctatccactatcctacgagacacgacgtccaaggtaacncgtccctttagggtttacttaacgaaagttcggaactcgtctagacgtaccgtgacgtccgagtcttcgttacgtacttacgngtgacgcgacggaacccgggaggggcgacgtacgaccgtaacccggttaacgtccgggg

SEQ ID NO: 312855 - DNA, 633 bp, Homo sapiens
  misc_feature: GZ8MTXP01B9NM8.52.53.E09.1.454.CMB.2.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
tcagcgcagtacgacacgaccggtgctcgatttagagagagtgtgtgggtttgggggaggcttggtccagcctggtggttccctgagactctcctgtgcagcctctggattctccgtcagtagcaactacatgagctgggtccgccaggctccgaggggaagggctggagtgggtctcaagttctttatgtcggtgtaccanatattatgctgactcgtgaaggccattcacatcnccagagacgagtccaggacngccttgtttctacaaatggactagtctggacgacctgaccgacacggctgtctattacgtgtgcgagacgaaccggngggggcgancaccgcccgtatcgcggggaccaacggggacccgtnaccgtctccncacgcctaccgaaccgacggccctacgtccggtccttccccgcgcccgtacccctcctacccgaacgacgccgtacccgtcgggtcgggggggacccaacggaccggcccgggtcccggtcgggccgttcggtcccgtcgggttaacgaaccggtccttaacccgttaaccgttaacgttacgtacgttccgtcggtacggacgggccgggttccgtgggacgaacgggcccgagactaagngng

SEQ ID NO: 312856 - DNA, 705 bp, Homo sapiens
  misc_feature: GZ8MTXP01BHIFH.52.53.E09.1.454.CMB.2.raw
  modified_base (253)..(253): a, c, t, g, unknown or other
  misc_feature (253)..(253): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagtcttgggttttccttgttgacttaatttttaaaaggtgtccagtgtggagtgcaggtggtggagtcgtgggggaggcttggccagccgtggtcgttcccngagactctctgtgcagcctctggatcncgtcagtanacaactacagtgagcgtacggtccgcgaggctaccggaagggggaacgggggctagggagttcgggtctacgaagtttccgtttagtggtacgggtagtaacccaataattaagttatcgtactacggtaccgttccggtaggggaaacgggtccctaattaccacctatcctacgaaggacgtacggacgtaccgaaaggacaacgtccttaggtttacttaacgaaatcgggaactgtcctaggaacgtcccgtaggaaccgacgtaaccgggttcttacgtttacgttaaagtttacggtcggtacggaaccggggaacgggttaaacccgggggaaacccgggggacggggggtaaccggaaccgggtaccggttaaccccgggttaaccccggtttaacgggttccggggg

SEQ ID NO: 312857 - DNA, 825 bp, Homo sapiens
  misc_feature: GZ8MTXP01A7I4H.52.53.E09.1.454.CMB.2.raw
  modified_base (317)..(317): a, c, t, g, unknown or other
  misc_feature (317)..(317): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagcttgggttttccttgttgcttaattttaaaaggtgtccagtgtggagtgcgaggtggtggagtcgtgggggagcttggtccagcctggtcgttccctgacgctctcctgtgcagcctgtggatcctccgtacagtagctaaactacatgacgcgtcgggtcccnccgacggcctaccgggaagggggaacgggggtcgtaggggaggttcggggtcttacgtaaaggtttccccttttaaggtcgggttccgggttaacggttaacccctaaacgttaaatttaacgtttaagtcggtaccctttacggtaaccccgtttcccggggtaaaggggtaaacccgggggtccccttaactttaccccaaaccgtactttaccccgtaacccgaaaggtaacggaccggttaacggaaccccgaaagggaaacctacgggttcccctttaggggttttacccttaaacgtaaaacggttcggaaacgttacggttcgttacgggaaaccgtcccgtaacggaacccggtaacccgtaccgggtctttaacgggttacctttaaagtttccggtgggtacggaaccggacgggaaacccggggaaccccgggggaggggggggaaccggtacgacccgggaacccgggttcccccggttaaaggttccccgggggg

SEQ ID NO: 312858 - DNA, 712 bp, Homo sapiens
  misc_feature: GZ8MTXP01DG6Z7.52.53.E09.1.454.CMB.2.raw
tcagcgcagtacgacacgaccggtgctcgatttagagagagtgtgttgggtttgggggctgtgggtccaggaggcagaactctgggtgtctcaccatggcctggatccctctacttctccccctcctcactctctgcacaggctctgaggcctcctatgagctgacacagccaccctggtgtctgtgtcctcaggacagacggccaggatcacctgctctggagatgctattgaccaaagcaaatatgtcttactggtaccagcagaacgcccggaccacggcccctgtcttgtactttaatttaataaagtactttagagtacggccctcgacggacccctgagcgtattctcgtggctccaagctcgacgaccgaacaaacgacgtacgtacgttacgaccctagtaccgagggtacgggacgttacccgaagggaccgaagggacgggaacggacgggcttaacggtaactttaagtttaacccgttggttaaccgtacggttacaaacttacgaaacggtaaacgaacggaccgtaaagggttcgggtaccccttaaacggttttaagttccggggtttaccggtttagggtttacccgggggaacggggttaaaaccgggggttacccttaaaaacggttccgggtaaaccccggttccggttaacgggtacccgaaccgggtaaccccgaacgggggttccccccg

SEQ ID NO: 312859 - DNA, 611 bp, Homo sapiens
  misc_feature: GZ8MTXP01CPAAL.52.53.E09.1.454.CMB.2.raw
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagctgcagccagagaacggccctcggtacttgatgagctacaacagtgagtggcagaccacgaggcggacggggggtaccgtacgtccgtgactcgtccttctcgacggtccgtcccgggctcggtcgggactggacgtccgtcctaccctcaccctacgtcctacccacgtccctccgacgtccgtaggacgggacggggtaggggtacgtaccttagttacgtcggtaccgaggtaccgggttcgggaaccgtaccggtgggtccgttaagggtttgggggttcggtttcggggacgggtaacggggacgttaacgggttcgacccggttgtacggtcacgccgttacgccgttcgtcccccg

SEQ ID NO: 312860 - DNA, 625 bp, Homo sapiens
  misc_feature: GZ8MTXP01BICAI.52.53.E09.1.454.CMB.2.raw
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (280)..(280): a, c, t, g, unknown or other
  misc_feature (280)..(280): n is a, c, g, or t
  modified_base (402)..(402): a, c, t, g, unknown or other
  misc_feature (402)..(402): n is a, c, g, or t
  modified_base (439)..(439): a, c, t, g, unknown or other
  misc_feature (439)..(439): n is a, c, g, or t
  modified_base (624)..(624): a, c, t, g, unknown or other
  misc_feature (624)..(624): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaagggctggagtgggtctcaagttctttatgtcggtggtaccanatatatgctgactcgngaaggcattcaccatcncagagacgagtccaggacagcttgttctacaaatggacagtcngacgacctgacgacacggctgtctattactgtgacgagaacggaacccggagggggcggagccaccggaccccgttaaagttcggtcggggaccgaaacggggacccgggtcaccgtctccncacgcctaccaccgacggccacgtccgtccttccccncgacccaccctcctaccaacgcgccacgtcggtggggggcacggacgcccggccgcggtccgtcggtccgtcggtaccgaacgggtacctttaaccgttaacctaacgttaaccgtacgttccggtcgtacgggttacgggccggggttcgtaacggggacgaacgggccgcgaacgtaaggcgng

SEQ ID NO: 312861 - DNA, 672 bp, Homo sapiens
  misc_feature: GZ8MTXP01B0CLZ.52.53.E09.1.454.CMB.2.raw
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgcacaggtctctctcccagcctgtgctgactcaactccgccctctcgccctctcgcccttcccgtgggacgcccttcggtacaacgcctacacctgccactctgagcgtaggtcggacacctaccaccgtacgccatcgcatgcatcagctgcacgccgaaggacggaaccggtcccttcggtacttgattggacgtactacgaaaactgtgacgtcggaccacggacccgacggacggggaccgggtaacggggggtaccgttacgtcccgtggtacttccgtccttacgtccgacggccgttcccggcgtcggtacgggacggttacggaccgtccgtacccttacccaccctacctaccgtacccgccctaaccggtcccctaccgtacggtccgtagggaaacggggtacggttacggggtactaaccgttaggtttaccgaggttaaccgacgggtaaccggtcgggacgttacgggttcgggttaacgtttaacggggg

SEQ ID NO: 312862 - DNA, 631 bp, Homo sapiens
  misc_feature: GZ8MTXP01EO4YD.52.53.E09.1.454.CMB.2.raw
  modified_base (210)..(210): a, c, t, g, unknown or other
  misc_feature (210)..(210): n is a, c, g, or t
  modified_base (234)..(234): a, c, t, g, unknown or other
  misc_feature (234)..(234): n is a, c, g, or t
  modified_base (290)..(290): a, c, t, g, unknown or other
  misc_feature (290)..(290): n is a, c, g, or t
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgcacagggtctctctcccagcctgtgctgactcaatcgccctntcgcctctcgccctccgtgggacncctcggtcaagctcacctgcactctgagcagtcggacactacaactacgccatcgnatggcatacagctgacgacgaccgaggaacggacggtccctaggtacttcgataggacgtctacgaaaagtagtggaaagtgggaccacgaccgaagacgggacgggaagggggtaccgtactccgagtactcggtcttacgtcgcggtcctccggctacgttggaccgtggaacgtcccgtacttacccgctaaaccactcctaacccgtctacccgttcgtaaaccggttcgtaggggaaccgggtaacggttacggggtacttaaccgttagtttacgttacgtttaacgacgggttaacggtacgggaccgttaagtccgggttaacgttttggggg

SEQ ID NO: 312863 - DNA, 679 bp, Homo sapiens
  misc_feature: GZ8MTXP01BLBSL.52.53.E09.1.454.CMB.2.raw
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatccgcccctctgcctctgccctcccgtgggacgccctcggtcaagctccacctgccactctgagcagtggacactacacctacgccatcgcatggcatcagcngcacgccaggaggaacggccctcggtatgagngagctacgaacgngtagagtggacgacgacccgaacgacgggaccgggacggggggtacgtaccgtcccgtgtacgtccgtccttcgtacgcgggtcccgtccggtcgtcggtacgggtacctggacgccgtacctacccttaccacccttactcccgtaccgaccgtcccgtacccgtaaggttcccggtaggggaacgggggtaacgggtaaggggttcttaaccgttaagttaccgtcggtacgtaacgggtaccggtaggggtacctacgggtcggtaacgttgggtttggggtccggttacggggacggtaacgggttaccgttggttcggtaacccccggttggtaacgtaaccggccgacccggtaagttccccgtcccgg

SEQ ID NO: 312864 - DNA, 726 bp, Homo sapiens
  misc_feature: GZ8MTXP01B12PM.52.53.E09.1.454.CMB.2.raw
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgcctctgcctctcgcctccctgggagcctcggtcaagctcacctgcactctgagcagtggcactacactacgcatcgcatggcatcagctgcagaccagaggaacggtcctacgtacttgagtgacggctacaacgtagtcgagtcgggacacgccgagtacggacggacgggggtaccgtacgtccgtgacgtcgtcttacgtcgcgggtccgtccggtcgtcggttcggggactcggaacgtccgtaccttaccgacctaaccgtacgtacccttcccgaacgtccccgtaccgtaaaggttcccgtagggaaacccggggaaggggttacgggggttacctaaccgtttaacggtttacgtcggtaaccggtacgggtaccgggtacgggtaaccgtacggttcgggtcgtttaacgggggtttcggggttaccgggtcggggttaaccgggtaacgggtaacccggtttaagggttcccggggttaaccccgttaacggggttacccggtcgggtaaccccggaccggttaacccgggggtccccttccccgggttccccccggg

SEQ ID NO: 312865 - DNA, 810 bp, Homo sapiens
  misc_feature: GZ8MTXP01BOHRV.52.53.E09.1.454.CMB.2.raw
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagcttgggttttccttgttgcttaattttaaaaggtgtccagtgtggagtgcgaggtggtggagtcggtgggggaggtcttggtccagtccgtggtcgttccctgacgtactctccgtgtcgcagtcctgtggtacttccgtccgtcagtacgactaaactacagtgacgtcgtcgggtccgccgaggcctaccggagggggaacgggcgtaggggacggttgggtctacgtaacgtttccgtttagtcggtacggtacggtacccaaacgtatttaacttagtcgtaccttacggtacccgttacgggtagggaaaccgggtcccgtaagttacccaacccgtattacccgaccgaacgggtaaacgaccgtaaaccggtacccgaaacgggtaaacccgtacggttacccttttacgggggttttacccttaaacgtaaaacgtccggtaaaccgtgttaccgtacggtaaaccggtacccgttacgggaaacccggaaaccgcccggggttaacttaccgttaacgtttaacgtttacggtcggttaccgggaacggggaaaccgggaaccgggaaaccccgggggacggggggggtaaccggaaccggtacccggttaaccccgggtccccccggtttaacgggttccccggggg

SEQ ID NO: 312866 - DNA, 785 bp, Homo sapiens
  misc_feature: GZ8MTXP01BAE56.52.53.E09.1.454.CMB.2.raw
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (289)..(289): a, c, t, g, unknown or other
  misc_feature (289)..(289): n is a, c, g, or t
  modified_base (784)..(784): a, c, t, g, unknown or other
  misc_feature (784)..(784): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaagggctggagtgggtctcaagttctttatggtcggtggtaccanattattangctgactccggtgaagggccattcaccatctccagagacgagtaccaaggacacgccttgttactacaaatggacngtctgacgacctgatgactacggtctcgtacttatacgtgtacggacgtaggaacggaacccggaggggggccggacgtacccgaccggtaccccggttaaagttccgggtaccgggggaacccgtaacccgggggtaaccccggggtccaacccgggttccctacccgtaccgaccgtccctaccccgaaccggtaaccggggtcccctaccgttcccgggttaccccttcccccgtaccgggtacccctaaccccggttcccctaacccggaaacgacccggtaccccgtaacccgttccgggggtaaccggggggtcccaaccggtccgggtacccggccccggtcgggtccgttccgggtcccgttacggggtaccgtaaaccggttacccgttaaccgttaactttaaccgaccggttaacgtcccgggtaacgttcggggaccgggttcggggtccggtggaaccgaacggggccaacgtaacgttggng

SEQ ID NO: 312867 - DNA, 578 bp, Homo sapiens
  misc_feature: GZ8MTXP01B1UEZ.52.53.E09.1.454.CMB.2.raw
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgcatcgcatgcatcagctgcagccagagaaggccctggtattgatgagctcaanagtgagngcacgcacgaggcggacggggaccggtactcgtcgacgtcgtctcgtcgacggcgtccgcgtcgtggacgtagacgcgactacctacaccactcctccgaccgccgtaccgacgtacgtaggaggacggggagggtagtaacgtaagttaacgtagtacgaacggtacggtacggtacgtacgtacggtcgtaagtttcgggttcggttcgggcgggtacgggtaacgttaacggttcgttaccgtaaccgtacggtaacgaccgaccgacgtccgttccgtccccg

SEQ ID NO: 312868 - DNA, 702 bp, Homo sapiens
  misc_feature: GZ8MTXP01A9QUN.52.53.E09.1.454.CMB.2.raw
  modified_base (258)..(258): a, c, t, g, unknown or other
  misc_feature (258)..(258): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagcgtggtttctgtgctatttaaaaggtgtcagtgtggagtgcaggtggtggagtcgtgggggagcttggtccagccgtggtggttcccctggatctctcctgtgcncgtcctgtagtctccgtccgtataggtaacgacctaaactacagtggagtccgtcggggtacccgaccgtaggtaccgtaccgggaagggggtaacgggtcgtagggtacggttcggtactacgtaagtttcccgtttaggtcggtacggttacgtaaccaaacgttaattaacgttagtcgtaccgtcgtaaccgttccgggtagggaaaccgggtccctaattacccaacgtctacctaccgaacgacgaacgtacgtaccgaacgaacgtacgtaccgttacggttacgttaacgtaaagtaacgtaacgtacgtacgtacgacgaccgtacggacgtaccgacgtcgtcgttacgttaacgttacgtcgtacggacggacggaaccggaaccgggacggggaacgggacggaccgacccgtaacccgttaaccggtccgg

SEQ ID NO: 312869 - DNA, 551 bp, Homo sapiens
  misc_feature: GZ8MTXP02G02EM.52.53.E09.1.454.CMB.2.raw
  modified_base (355)..(355): a, c, t, g, unknown or other
  misc_feature (355)..(355): n is a, c, g, or t
  modified_base (532)..(532): a, c, t, g, unknown or other
  misc_feature (532)..(532): n is a, c, g, or t
  modified_base (550)..(551): a, c, t, g, unknown or other
  misc_feature (550)..(551): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccaggtaaggggctggagtgggtctcaagtctttatgtcggtggtaccacatattatgctgactccgtgaagggccattcaccatctccagagacgagtccaggaacagcctgttcttcaaatggacagtctgagacctgacgacacggctgtctattactgtgcgagagaacccgagggggcggagcacgccccgtaattcgnggggccaaggggaaccccgggtcaccgtctcctcagccctccaccaaacgggcccatcggtccttccccctggccacccctcctccaaagacgccaacctcgtgggggccacgacgccgggccctgggctgccctggtcaagggactacttcctatactatcgctgacgcgggtcgnggacacggcgacagtagnn

SEQ ID NO: 312870 - DNA, 537 bp, Homo sapiens
  misc_feature: GZ8MTXP02I9NNF.52.53.E09.1.454.CMB.2.raw
  modified_base (273)..(273): a, c, t, g, unknown or other
  misc_feature (273)..(273): n is a, c, g, or t
  modified_base (304)..(304): a, c, t, g, unknown or other
  misc_feature (304)..(304): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggtttcctgttgctatttaaaaggtgtccagtgtggagtgcaggtggtggagtcgtgggggaggcttggtccagcctggtggttccctgagactctcctgtgcagcctctggattcnccgtcagtagcaactacatgagctgggtccnccaggctccgaggggagggctggagtgggtctcaagtcctttangtcggtgtaccanatnttangctgactcgngaggccattcacatcncagacgacgagtccaggacagccttgtttcctanaagtgacngtcagacgactgacgacgacggtctagtacttacgttacgtgtacgacgaagaaccggaaccggagggggtcggacgccgtaccggacccgttaagtccgg

SEQ ID NO: 312871 - DNA, 608 bp, Homo sapiens
  misc_feature: GZ8MTXP02H8L8A.52.53.E09.1.454.CMB.2.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
  modified_base (607)..(607): a, c, t, g, unknown or other
  misc_feature (607)..(607): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaagggctggagtgggtctcaagtctttatgtcggtgtaccanatattatgctgactcgtgaaggccattcacatcncagagacgagtccaggacagcctgttctcaaatggacagtctgagacctgacgacacggctgtctattactgtgcgagagaacccgagggggcggagcacgccccgtaattcgnggggccaggggaacccggtnaccgtctcctcacgccctccaaccaacgggcccagtccggtcccttcccccgtggcccacccctcctcccaacgacgcacccgtcgtcgggggccacgacggccgggtccccgtggggcctcggacccgtcgggtaccgaaacgggtaccttaaccgtttcctaacgttaccggaattccggaccgttcggacggtccggggcgttcggggaccgaaagggccggacgaacgtacgacgng

SEQ ID NO: 312872 - DNA, 587 bp, Homo sapiens
  misc_feature: GZ8MTXP02HVTNR.52.53.E09.1.454.CMB.2.raw
  modified_base (352)..(352): a, c, t, g, unknown or other
  misc_feature (352)..(352): n is a, c, g, or t
  modified_base (422)..(422): a, c, t, g, unknown or other
  misc_feature (422)..(422): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactcgtgaaggccattcaccatctccagagacgagtccaaggaacagcctgttctcaaatggacagtctgagacctgacgacacggctgtctattactgtgcgagagaacccgagggggcggagcacgccccgtaatcgnggggcacggggacccggtcaccgtctcctcgagccctccaccgaacggcccagtccggtccttcccccgngccaccccgtcctaccaagacgccacctcgtcgggggacacgacgccggcccgtgggcctcggccgtgggtaccaaacgggtaccttaccgttcctaaagtaccggaacttccggcctaggacggccgggggctcgggaccaaacggggtccacacgtacgngng

SEQ ID NO: 312873 - DNA, 659 bp, Homo sapiens
  misc_feature: GZ8MTXP02FZAR7.52.53.E09.1.454.CMB.2.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
tcagcgcagtacgacacgaccggtgctcgatttagagagagtgtgttgggtttgggagctctgggagaggagcccagcactgggattccgaggtgtttccattcagtgatctgcactgaacacagaggactcgccatggagtttgggctgagcgtgtttcgtgtaggcgtattaaagtgtcagtgtgagtgcaggtggtggngtgtgggnggcgtgtcgngcgtggtcgttccgtgagactctctgtgcacgtctcgtgtacttctccgtcgtagtagacaactactagtgagcgtcggtccgccgacggcgtaccggaacgggacgggtacggtggtaggtcggtcgtacgtaagttaccgtttagttcggttcggttacggtaaccgtaacgtaattagttagtcgtcgtacgtaccgtacggtacggtaacgggtaccgtacgttaccgtacctactaccgtaccgacgacgaacgtacgtaccgaacgaacgtacgtacgttacgtttacgttacgtaacgtacgtacgtacgtacgtacgtacgtacgtacgacgacgtacgtacgttcgttacttacgttagttacgtacgtacggaacggaacggaaccggacggggacgggacggaccgaccggtacccgttaccgtacgg

SEQ ID NO: 312874 - DNA, 534 bp, Homo sapiens
  misc_feature: GZ8MTXP02HOU09.52.53.E09.1.454.CMB.2.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
  modified_base (354)..(354): a, c, t, g, unknown or other
  misc_feature (354)..(354): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (533)..(534): a, c, t, g, unknown or other
  misc_feature (533)..(534): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccanatattatgctgactccgtgaagggccattcaccatctccagagacgagtccaggaacagcctgttctcaaatggacagtctgagacctgacgacacggctgtctattacngtgcgagagaacccgagggggcggagcacgccccgtaattcgnggggccaggggaacccgggtcaccgtctcctcagcctccaccaacgggcccagtccggtccttccccctggccacccctcctccaagacgcacctcgtgggggcacgagcggccctgggctcgcctggtcaaggactacttccatacgactcgctgacgcggctggcaaggcncanagnn

SEQ ID NO: 312875 - DNA, 554 bp, Homo sapiens
  misc_feature: GZ8MTXP02H5DL0.52.53.E09.1.454.CMB.2.raw
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
  modified_base (355)..(355): a, c, t, g, unknown or other
  misc_feature (355)..(355): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgacctccctgggagcctcggtcaagctcacctgcactctgagcattgggcactacacctacgccatcgcatggcatcagctgcagccagagaagggccctggtacttgatgaggctnaacagtgatggcagccanaggcgaggggggacgtatccctgatcgctttctcaggcctccggctcgnggggactgagcgctacctcaccatcctccacgcctccacgtctgaggacggagggtagacgtattaactgtacgtagacggtagggacgacgtcggtcgtagtttggggttcggtttcgggtcgggtacggggaccggtaacggttacggtaaccggtaccgtacggttacgacggacccgaaaccggtacgtccccgg

SEQ ID NO: 312876 - DNA, 522 bp, Homo sapiens
  misc_feature: GZ8MTXP02HXAI1.52.53.E09.1.454.CMB.2.raw
  modified_base (304)..(304): a, c, t, g, unknown or other
  misc_feature (304)..(304): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagctgcagccagagaaggccctcggtacttgatgagctacaacagtgatggcagccanagcgagggggaccgtatccctgatcgcttctcaggctccgggctcgtggggactgagcgctacctcaccatctcccagccctccagtctagaggacgaggggtnactattacngtcagacgtgggacacgtggctagtttggggtgttcgggcggtacgggaccgtaagttcgaaccgtccgtaaggtccgacgacccgaaacggtcctacgcccccg

SEQ ID NO: 312877 - DNA, 554 bp, Homo sapiens
  misc_feature: GZ8MTXP02GTLGD.52.53.E09.1.454.CMB.2.raw
  modified_base (357)..(357): a, c, t, g, unknown or other
  misc_feature (357)..(357): n is a, c, g, or t
  modified_base (551)..(551): a, c, t, g, unknown or other
  misc_feature (551)..(551): n is a, c, g, or t
  modified_base (553)..(554): a, c, t, g, unknown or other
  misc_feature (553)..(554): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttatgtcggtggtaccacatattatgctgactccgtgaagggccattcaccatctccagagacgagtccaggaacagcctgtttctacaaatggacagtctgagacctgacgacacggctgtctattactgtgcgagacgaacccgagggggcgagcacgccccgtattcgnggggccaggggaacccggtcaccgtctcctcacgccctccaccgaacgggcccagtccggtccttcccccgtgcccacccctcctaccaagacgccacctcgtcgggggcacgacgccggccctggggctcggccctggtccaaaggacctacttcctatacgactcgctgacgcgggctggcgaaggcgacanann

SEQ ID NO: 312878 - DNA, 551 bp, Homo sapiens
  misc_feature: GZ8MTXP02F4L9I.52.53.E09.1.454.CMB.2.raw
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (550)..(551): a, c, t, g, unknown or other
  misc_feature (550)..(551): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccattcaccatctccagagacgagtccaggaacagcctgtttctcaaatggacagtctgagacctgacgacacggctgtctattactgtgcgagagaacccgagggggcggagcacgccccgtaatcgnggggccaggggacccgggtnaccgtctccncagcctccaccaagggcccatccggtccttccccctggccacccctcctccaagacgcaccgtcgtgggggccacgacgccgggcccctggggcctcggccctagggtccaaagggacttacttccctataccgatcgctgacgcgggctggcaaggcgatacagnn

SEQ ID NO: 312879 - DNA, 527 bp, Homo sapiens
  misc_feature: GZ8MTXP02G1KWC.52.53.E09.1.454.CMB.2.raw
  modified_base (202)..(202): a, c, t, g, unknown or other
  misc_feature (202)..(202): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (445)..(445): a, c, t, g, unknown or other
  misc_feature (445)..(445): n is a, c, g, or t
  modified_base (511)..(511): a, c, t, g, unknown or other
  misc_feature (511)..(511): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(527): a, c, t, g, unknown or other
  misc_feature (526)..(527): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccanatattatgctgactccgtgaaggccattcaccatctccagagacgagtccaggaacagcctgttctcaaatggacagtctgagacctgacgacacggctgtctattactgtgcgagagaacccgagggggcggancacgccccgtaattcgnggggccaggggaacccggtnaccgtctcctcagcctccaccaacgggcccatcgtcctcccctgccaccctcctccaagacgccacctcgngggggcacgacgcggccctgggctcgcctggtcaaggctacttctatacgactcgctgacgcggcnggcaaggcgananann

SEQ ID NO: 312880 - DNA, 615 bp, Homo sapiens
  misc_feature: GZ8MTXP02HIEYE.52.53.E09.1.454.CMB.2.raw
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
  modified_base (452)..(452): a, c, t, g, unknown or other
  misc_feature (452)..(452): n is a, c, g, or t
  modified_base (614)..(614): a, c, t, g, unknown or other
  misc_feature (614)..(614): n is a, c, g, or t
tcagcgcagtacgacacgaccggtgctcgatttagagagagtgtgttgggtttggggaggcttggtccagcctggtggttccctgagactctcctgtgcacgcctctggattctccgtcagtagcaactacatgagctgggtccgccaggctccagggaagggctggagtgggtctcaagtctttatgtcggtgtacacatattatgctgactcgtgaaggccattcaccatctcagagacgagtccaggaacagcctgttctacaaatggacagtctgagacctgacgacacggctgtctaattactgtgcgagagaacccgagggggcggagcacgccccgtaaattcgnggggccagggaacccgggtcaccgtcnccgtnagcctccaaccgaagggcccaagtcggtccttcccccgnggcctacccctccctacccgaaaggaccncctaccgtcggtcggggacacgacggcccgggtcccgtggggcctcggaccgtcggtaaccgaaacggtaccctttaaccgttacctaaacgtaccggtactaccgtaccgtacggtacggaccgggaccggtcggacggaacggacgacgacgtacgacgng

SEQ ID NO: 312881 - DNA, 635 bp, Homo sapiens
  misc_feature: GZ8MTXP02I2XZP.52.53.E09.1.454.CMB.2.raw
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (339)..(339): a, c, t, g, unknown or other
  misc_feature (339)..(339): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgagggaaggggctggagtgggtctcaagtctttangtcggtggtaccanatattangctgactccgtgaagggccattccacatctccagagacgagtccaggaacagcctgttctcaaatggacagtctgagacctgacgacacggctgtctattactgtgcgagacgaacccgagggggcggancacgccccgtaatcgtcggggccacggggacccggtcaccgtctccctcgacgcctaccgacccgaaacgggccctaagtcccggtccttcccccgtcggcccaccccgtcctaccaacgacgaccaccgtcgtacgggggccacgacggcccggcccgtcggggcctacggccgtcgggtaccgaaacgggtaccttaaccgttaccgtaacgttaccggaacttccggccgttacgggacggccgggggtcctaaggggaccgaaaacggggccgtaaccgacgtaacggcgcg

SEQ ID NO: 312882 - DNA, 702 bp, Homo sapiens
  misc_feature: GZ8MTXP02GWH32.52.53.E09.1.454.CMB.2.raw
  modified_base (245)..(245): a, c, t, g, unknown or other
  misc_feature (245)..(245): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgccctcccgtgggacgcctcggtacaagcctccacctgccactctgagcaggtggcactacacctacgcatcgnatggcatcagctgcacgccagaggaacggccctcggtactgagtggaggctacaacagtgagtggcacgaccacgacggcggacgggggacgtactcccgtagacgtccgcttccgtcgacggtccgtcccggtccgtcggtacggggacgttaggacggtcccggtaccctaacccgtcccaaccccgtacttcccctacccgaacggtccccctaccgtacggttacccgttcggggaaacggggaccgggttagggggttactaacgtttaacgttaccgttcggtacgtaacgggtaccgggtacgggtaccgtaacggttcgggtaaccgtttaggggttttcgggggttcgggtttaccgggggacggggtaaccggggtaaccgtaacggtttccggaacccgttacggtacggtaccgacggtacccgaacgggtcccgttcccccggg

SEQ ID NO: 312883 - DNA, 515 bp, Homo sapiens
  misc_feature: GZ8MTXP02GM1G1.52.53.E09.1.454.CMB.2.raw
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatgggcagccacagcgagggggaccgtatccctgatcgcttctcgaggctccggctcgtgggactgagcgctacctcaccatctccagcctcagtctgaggacgagggtgacttattactgtcagacgtgggacagtggctagtttggggtgttcgggcgggacgggaccgtaaggttcgaccgtcgtaggtccacggtcccgaaggcctacgtcccccg

SEQ ID NO: 312884 - DNA, 575 bp, Homo sapiens
  misc_feature: GZ8MTXP02HX3ZF.52.53.E09.1.454.CMB.2.raw
  modified_base (571)..(571): a, c, t, g, unknown or other
  misc_feature (571)..(571): n is a, c, g, or t
  modified_base (574)..(575): a, c, t, g, unknown or other
  misc_feature (574)..(575): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccaggggaaggggctggagtgggtctcaagtctttatgtcggtggtaccacatattatgctgactcgtgaagggccattcaccatctccagagacgagtccaggaacagcctgtttctcaaatggacagtctgagacctgacgacacggctgtctattactgtgcgagagaacccgagggggcggagcacgccccgtaacttcgcggggccaggggaaccccgggtcaccggtctccctcacgcctacccacccaaacggggcccacgtccggtccttccccccgtggccctacccctcctacccaacgacgccaccctcgtcgggggccacgacggccgggccctcggggcctggccctgggtaccaaggacctacttcctagtaccgactcgctgacgcgggctgggcaaggcgcanagnn

SEQ ID NO: 312885 - DNA, 581 bp, Homo sapiens
  misc_feature: GZ8MTXP02GDLZV.52.53.E09.1.454.CMB.2.raw
  modified_base (332)..(332): a, c, t, g, unknown or other
  misc_feature (332)..(332): n is a, c, g, or t
  modified_base (560)..(560): a, c, t, g, unknown or other
  misc_feature (560)..(560): n is a, c, g, or t
  modified_base (580)..(581): a, c, t, g, unknown or other
  misc_feature (580)..(581): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagtctttatggtcggtggtaccacatattatgctgactccgtgaagggccattcacatctccagagacgagtccaggaacagcctgttctacaaatggacagtctgagacctgacgacacggctgtctattactgtgcgagacgaacccgngggggcgagcacgccccgtaatcgcggggccaggggaacccgggtcaccgtctcctcacgccctaccaaccgaacgggcccacgtccggtcccttcccccgtggcccacccctcctaccaagacgccaccgtcgtcgggggccacgacggccggcccgtacggacctcgccgtggtaccgaacggtaccttacttacctataccgactcgactcggacggccgggacncgggacaagggcacagacgnn

SEQ ID NO: 312886 - DNA, 573 bp, Homo sapiens
  misc_feature: GZ8MTXP02HETS8.52.53.E09.1.454.CMB.2.raw
  modified_base (184)..(184): a, c, t, g, unknown or other
  misc_feature (184)..(184): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggancctcggtcaagctcacctgcactctgagcagtgggcactacacctacgccatcgcatggcatcagctgcagccagagaacgggccctcggtacttgatgaggctacaacgagtgatggcacgccacgaggcggaacggggggacgtactcccgtagactccgcttctcgaggtcctccggctcgtgggactgagccgtctacctcaaccatcctcacgccctcagtcgtaggacggacggtaggggtctacgtacgttacgagttaccgaagtacggtacgggacgtacgtgggtacttaggtttggggttcgttcgggggacggaacgggtaccaaggtttcggaacccgtacgtacggtacgacggacccgaacggtccgtccccgg

SEQ ID NO: 312887 - DNA, 616 bp, Homo sapiens
  misc_feature: GZ8MTXP02I6PR7.52.53.E09.1.454.CMB.2.raw
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagctgcagccagagaacggcctcggtacttgatgaggctacaacagtgatggcagccacagcggagggggaccgtacgccctgatcgccttctcgaggctccggctcgtggggactgagcgctacctcaccatctcccagtccctacagtccgtaggacggacgtacggggtagaacttagtttaaccgtgttacgaacgggtaccggttcggggaacctaaccggtgggaccgttaacgggtttttgggggtcggtttccgggggacgggggaaacggggtaacccgtaaaagggtttcggaaacccggttccgtacggggttaccgaacggtccccgaaaacgggtcccgtaccggttacccccccggg

SEQ ID NO: 312888 - DNA, 553 bp, Homo sapiens
  misc_feature: GZ8MTXP02HH598.52.53.E09.1.454.CMB.2.raw
  modified_base (231)..(231): a, c, t, g, unknown or other
  misc_feature (231)..(231): n is a, c, g, or t
  modified_base (350)..(350): a, c, t, g, unknown or other
  misc_feature (350)..(350): n is a, c, g, or t
  modified_base (375)..(375): a, c, t, g, unknown or other
  misc_feature (375)..(375): n is a, c, g, or t
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgcacagggtctctctcccagcctgtgctgactcaatcgcctctgcctctcgcctccgtgggacncctcggtcaagctcacctgcactctgagcagtggcactacacctacgccatcgcatgcatcagctgcagccagagaacggcctggtactgatgagctacaacagtgatggcacgccaanaggcggaagggggacgtactcccgngactcgtcttctcgaggcctcgctcgtggactgagcgtacctacctccacctactccgtaccacgtccctaccgacgttccacgggtacggaaccgggtagggttacgtaacgttaacgttaacgtcgttaaccgaggtaaccggttacggggaactacggtcggtaacgtttacggg

SEQ ID NO: 312889 - DNA, 573 bp, Homo sapiens
  misc_feature: GZ8MTXP02HUKKI.52.53.E09.1.454.CMB.2.raw
  modified_base (201)..(201): a, c, t, g, unknown or other
  misc_feature (201)..(201): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
  modified_base (572)..(573): a, c, t, g, unknown or other
  misc_feature (572)..(573): n is a, c, g, or t
tcagcgcagtacgacacgaccggtgctcgatttagagagagtgtgtgggtttgggggaggcttggtccagcctagtggttccctgagactctcctgtgcagcctctggattctccgtcagtagcaactacatgagctgggtccgccaggctccgagggaaggggctggagtgggtctcaagtctttatgtcggtgtaccanatattatgctgactcgtgaaggccattcaccatctccagagacgagtccaggaacagcctgttctcaaatggacagtctgagacctgacgacacggctgtctattactgtgcgagacgaacccgngggggcggancacgccccgtaattcgcggggccacggggaacccggtnaccgtcncctcagccctacaccgaacggcccagtccggtcccttcccccgtggacccacccccgtctacccgaacgacgccaccgtcgtcgggggaccacgacggccggccccgtggggcctcggcccgtggtaccaaggacctactttccaagtacgactccggctggacgcgggcaaggcaagggtcacaagtcgnn

SEQ ID NO: 312890 - DNA, 511 bp, Homo sapiens
  misc_feature: GZ8MTXP02GVNCE.52.53.E09.1.454.CMB.2.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
  modified_base (382)..(383): a, c, t, g, unknown or other
  misc_feature (382)..(383): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (490)..(490): a, c, t, g, unknown or other
  misc_feature (490)..(490): n is a, c, g, or t
  modified_base (510)..(511): a, c, t, g, unknown or other
  misc_feature (510)..(511): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttatgtcggtggtaccanatattatgctgactccgtgaagggccattcaccatctccagagacgagtccaggaacngccttgttctcaaatggacagtctgagacctgacgacacggctgtctattactgtgcgagacgaacccgagggggcgancaccgccccgtatcgnggggccaggggacccgtnacgtctcnngcctcacagccatcgtctcccngcnccncncancncaccngtcgggcncgngccggcctggcctgcctggtacaggactacttccatacgactcgctggcgcgggcncggacgacggcactagacgnn

SEQ ID NO: 312891 - DNA, 609 bp, Homo sapiens
  misc_feature: GZ8MTXP02JUMCZ.52.53.E09.1.454.CMB.2.raw
  modified_base (332)..(332): a, c, t, g, unknown or other
  misc_feature (332)..(332): n is a, c, g, or t
  modified_base (388)..(388): a, c, t, g, unknown or other
  misc_feature (388)..(388): n is a, c, g, or t
  modified_base (608)..(608): a, c, t, g, unknown or other
  misc_feature (608)..(608): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttatgtcggtggtaccacatattatgctgactccgtgaagggccattcacatctccagagacgagtccaggaacagccttgttctcaaagtggacagtctgagaccctgacgacacggctgtctattactgtgcgagacgaacccgngggggcggagcaccgccccgtattcgcggggccaggggacccggtcaccgtctccncgacgccctccaaccgaacgggcccagtccgtcccttcccccgcggcccacccctccctaccgaacgacgccacccgtcggtcgggggccacgacggccgggcccgtcggggcctcggcccgttcggtaccgaacggtaccttaccgttcctaacgttaccgacgttccggcgtcggacggtccggggcgtcgggaccgaacgggcgacgacgtacgcgng

SEQ ID NO: 312892 - DNA, 533 bp, Homo sapiens
  misc_feature: GZ8MTXP02GDPTU.52.53.E09.1.454.CMB.2.raw
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacaggcgacgggggacgtatcccgtgatcgcttctcaggctccggctcgtgggactgagcgctacctcaccatcctcacgcctaccagtccgtggaacgggacgtaggggtcaactattacctgtacaggacggtgggactagtggactggtttggggtcgttcggggacggtacgggacctaggtttcgaacccgtcgtaggtaccacggacccgaaggccttcccgg

SEQ ID NO: 312893 - DNA, 601 bp, Homo sapiens
  misc_feature: GZ8MTXP02G836J.52.53.E09.1.454.CMB.2.raw
  modified_base (204)..(204): a, c, t, g, unknown or other
  misc_feature (204)..(204): n is a, c, g, or t
  modified_base (351)..(351): a, c, t, g, unknown or other
  misc_feature (351)..(351): n is a, c, g, or t
  modified_base (599)..(600): a, c, t, g, unknown or other
  misc_feature (599)..(600): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgaggggaaggggctggagtgggtctcaagtctttatggtcggtggtaccanatattatgctgactcgtgaaggccattcacatctccagagacgagtccaggaacagcctgttctacaaatggacagtctgagacctgacgacacggctgtctatactgtgcgagagaacccgaggggcgagcacgccccgtaatcgnggggccagggaacccggtcaccgtctcctcacgccctccaaccgaacggcccacgtccggtcccttcccccgtcgccctacccctccctacccgaaacgacgcctacccgtcggtcgggggccacgacggccgggcccgtcggcctcggcccgtggtaccgaaacgggtacttaccgttacctaacgtaaccgacgtccgcgtacgacggccggggcgtcgggacgaaacgggccgacgaacgtacgnng

SEQ ID NO: 312894 - DNA, 651 bp, Homo sapiens
  misc_feature: GZ8MTXP02GS9L8.52.53.E09.1.454.CMB.2.raw
  modified_base (355)..(355): a, c, t, g, unknown or other
  misc_feature (355)..(355): n is a, c, g, or t
  modified_base (648)..(648): a, c, t, g, unknown or other
  misc_feature (648)..(648): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgatgactccgtgaagggccattcaccatctccagagacgagtccaggaacagcctgttctcaaatggacagtctgagacctgacgacacggctgtctattactgtgcgagagaaacccgagggggcggagcacgccccgtaattcgnggggccaggggaacccgggtcaccgtctccgtcacgccctaccacccgaaacggggccccaacgtccggtccctttcccccgtcgggcccacccccttccctaccccaaacggaccgaccaacccttccgtcggggggccaaccgacggcccgggcccccgtgggggcccttcggcccgttacgggtaccaaacggggtacccttaaccctttcccgtaacgttaccggaacgttccggccgttcggacggtcccggggcttcggggccaaaaggggccggacaacgtacggngcg

SEQ ID NO: 312895 - DNA, 588 bp, Homo sapiens
  misc_feature: GZ8MTXP02JSILY.52.53.E09.1.454.CMB.2.raw
  modified_base (208)..(208): a, c, t, g, unknown or other
  misc_feature (208)..(208): n is a, c, g, or t
  modified_base (256)..(256): a, c, t, g, unknown or other
  misc_feature (256)..(256): n is a, c, g, or t
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
  modified_base (388)..(388): a, c, t, g, unknown or other
  misc_feature (388)..(388): n is a, c, g, or t
  modified_base (433)..(433): a, c, t, g, unknown or other
  misc_feature (433)..(433): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattangctgactccgtgaaggccattcacatctcagagacgagtccaggaacngccttgttctacaaatggactgtctgacgacctgacgacacggctgtctattacgtgtcgacgagacgaacccggngggggcgancgacccgtccccgtaatcgcggggccaacggggacccgtcaccgtcncctcacgccctaccgaccgacggcccagtcccgtccctcccccgngcccacccctcctaccaacgcgccaccgtcggtcgggggccacgacggcccggcccgtgggcctcggccgtgggtaccaacggtaccttaccttcctacgtaccgactccgcgtacgaccgggtccggcgtgggacgaacggcgactagcgngng

SEQ ID NO: 312896 - DNA, 568 bp, Homo sapiens
  misc_feature: GZ8MTXP02JF3BR.52.53.E09.1.454.CMB.2.raw
  modified_base (329)..(329): a, c, t, g, unknown or other
  misc_feature (329)..(329): n is a, c, g, or t
  modified_base (356)..(356): a, c, t, g, unknown or other
  misc_feature (356)..(356): n is a, c, g, or t
  modified_base (559)..(559): a, c, t, g, unknown or other
  misc_feature (559)..(559): n is a, c, g, or t
  modified_base (565)..(565): a, c, t, g, unknown or other
  misc_feature (565)..(565): n is a, c, g, or t
  modified_base (567)..(568): a, c, t, g, unknown or other
  misc_feature (567)..(568): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccattcaccatctccagagacgagtccaggaacagcctgttctcaaatggacagtctgagacctgacgacacggctgtctattactgtgcgagacgaacccgngggggcggagcacgccccgtaactcgnggggccaggggaacccgggtcaccggtctacctcagccctccaaccaaacggggcccacgtccggtccttccccctggccacccctcctaccaacgacgcacctcgtgggggccacgacggccggcccgtgggcctcggcctaggtcgaaacggacttacttcctatacgactcgctggacgcgggcgcggacgaacggccgntaacgngnn

SEQ ID NO: 312897 - DNA, 481 bp, Homo sapiens
  misc_feature: GZ8MTXP02JWVYT.52.53.E09.1.454.CMB.2.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
  modified_base (419)..(419): a, c, t, g, unknown or other
  misc_feature (419)..(419): n is a, c, g, or t
  modified_base (459)..(459): a, c, t, g, unknown or other
  misc_feature (459)..(459): n is a, c, g, or t
tcagcgcagtacgacacgaccggtgctcgatttagagagagtgtgttgggtttgggcacgaccggtgctcgatttagagagagtgtgttgggtttggggagcagagctctgggagtctgcaccatggcttggaccccactcctcttcctcaccctcctctccactgcacaggtctctctcccagcctgtgctgactcaatcgccctctgcctctgcctccctggggancctcggtcaagctcacctgcactctnagcagtgggcactacacctacgccatcgcatggcatcagctgcagccagagaagggccctcggtcttgntgagctcaacngtgatggcagccanagcgaggggggacgtatccctgatcgcttctcagggctccggctctgggactgagcgctacctcaccatcnccagcctcagtctgaggacgagggtcgactattactgtcngacgtgggacacgtggcttagg

SEQ ID NO: 312898 - DNA, 551 bp, Homo sapiens
  misc_feature: GZ8MTXP02GSUKI.52.53.E09.1.454.CMB.2.raw
  modified_base (353)..(353): a, c, t, g, unknown or other
  misc_feature (353)..(353): n is a, c, g, or t
  modified_base (429)..(429): a, c, t, g, unknown or other
  misc_feature (429)..(429): n is a, c, g, or t
  modified_base (545)..(545): a, c, t, g, unknown or other
  misc_feature (545)..(545): n is a, c, g, or t
  modified_base (548)..(548): a, c, t, g, unknown or other
  misc_feature (548)..(548): n is a, c, g, or t
  modified_base (550)..(551): a, c, t, g, unknown or other
  misc_feature (550)..(551): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattatgctgactccgtgaagggccattcaccatctccagagacgagtccaggaacagcctgttctcaaatggacagtctgagacctgacgacacggctgtctattactgtgcgagagaacccgagggggcggagcacgccccgtaatcgnggggccacggggaacccgggtcaccgtctacctcacgcctccaaccaacgggccctacgtccggtccttcccccgnggcccaccctcctaccaacgacgccacctcgtcgggggcacgacgcggcccgtgggcctggcctggacaaggactacttactatacgactcgactgacgtcggctggcaaggcganacngnn

SEQ ID NO: 312899 - DNA, 568 bp, Homo sapiens
  misc_feature: GZ8MTXP02G0AHK.52.53.E09.1.454.CMB.2.raw
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (566)..(567): a, c, t, g, unknown or other
  misc_feature (566)..(567): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaagggctggagtgggtctcaagtcttttatgtcggtggtaccacatattatgctgactccgtgaaggccgattcaccatctccagagacgagtccaggaacagcctgttcttcaaatggacagtctgagcctgacgacacggctgtctattactgtgcgagagaacccgaggggcggagcacgccccgtaatcgnggggccagggacccgtnaccgtcncctcacgcctccgaccaacgggcccagtcccggtccttcccccgtggcccacccctcctaccaagacgccacctcgtcggggcacgacgccggccctgggctcgccgtggtaccaaggacttaccgttcctaagtaccgacttcgcgtacggacggccgggctcggcgaaacggcgactaacgtacggnng

SEQ ID NO: 312900 - DNA, 508 bp, Homo sapiens
  misc_feature: GZ8MTXP02IVLAB.52.53.E09.1.454.CMB.2.raw
  modified_base (414)..(414): a, c, t, g, unknown or other
  misc_feature (414)..(414): n is a, c, g, or t
  modified_base (444)..(444): a, c, t, g, unknown or other
  misc_feature (444)..(444): n is a, c, g, or t
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgcctctgcctctgcctccctgggagcctcggtcaagctcacctgcactctgagcagtgggcactacacctacgccatcgcatggcatcagctgcagccagagaggccctggtactgatgagctcaacagtgatggcagccacagcgagggggaccgtactccgagactcgcttctcgaggctccgggctcgtggggactgagcgctacctcaccatcctccagccctccagtctaggaggacgaggtgactattacngtcgagcgtgggacacgtgctagtttgggnggttcgggacggtagggacctaagttcgacgtccgaggtcgacgcccgaaggcctcgtcccccg

SEQ ID NO: 312901 - DNA, 520 bp, Homo sapiens
  misc_feature: GZ8MTXP02GQ049.52.53.E09.1.454.CMB.2.raw
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgactccctgggagcctcggtcaagctcacctgcactctgagcattgggcactacacctacgccatcgcatggcatcagctgcagccagagaagggccctcggtacttgatgaggctcaacagtgatggcagccanaggcgagggggacgtatccctgatcgcttctcaggctccgctcgngggactgagcgctacctcaccatcctccagcctcagtctgaggacgaggtnactatacgngtcagacgtggaacncgtgctagtttgggtcgttacggcgggacggaacccgaaggtttcggaaacccgttcgtaacgggtaccacggacccgaagggtccctcccggg

SEQ ID NO: 312902 - DNA, 517 bp, Homo sapiens
  misc_feature: GZ8MTXP02HF422.52.53.E09.1.454.CMB.2.raw
  modified_base (201)..(201): a, c, t, g, unknown or other
  misc_feature (201)..(201): n is a, c, g, or t
  modified_base (352)..(352): a, c, t, g, unknown or other
  misc_feature (352)..(352): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
  modified_base (498)..(498): a, c, t, g, unknown or other
  misc_feature (498)..(498): n is a, c, g, or t
  modified_base (516)..(517): a, c, t, g, unknown or other
  misc_feature (516)..(517): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccaggggaagggctggagtgggtctcaagtctttatgtcggtggtaccanatattatgctgactcgtgaagggccattcaccatctccagagacgagtccaggaacagcctgttctcaaatggacagtctgagacctgacgacacggctgtctattactgtgcgagagaacccgaggggcggagcacgccccgtaattcgnggggccagggaacccggtcaccgtcncctcacgccncacaggcccatcgctccctgcaccctcncaagacgcactcgnggggcacgagccggcctgggctgccctggtcaaaggctaacttccgtatcgactcgctgacgcggcgnggacgaacggcacagagnn

SEQ ID NO: 312903 - DNA, 578 bp, Homo sapiens
  misc_feature: GZ8MTXP02ICEVZ.52.53.E09.1.454.CMB.2.raw
  modified_base (234)..(234): a, c, t, g, unknown or other
  misc_feature (234)..(234): n is a, c, g, or t
  modified_base (289)..(289): a, c, t, g, unknown or other
  misc_feature (289)..(289): n is a, c, g, or t
  modified_base (341)..(341): a, c, t, g, unknown or other
  misc_feature (341)..(341): n is a, c, g, or t
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgcacagggtctctctcccagcctgtgctgactcaatccgccctctgcctctcgcctcccgtgggacncctcggtcaagctcacctgcactctgagcaggtggcactacacctacgccatcgnatggcatcagctgcagccagagaacggccctggtactgatgagctacaacgngtgatggcacgccagagcggacgggggacgtactcccgtagacgtcgtcttcgtcgacggtcctccggctcggtcgggactggacgccgtacctacccgtccaccactccctaccgacgtccctaccgtacgtccgtagggtaacgggacggtacggggtacgtaacgttacgtttacgtacgtaaccgtaacggtaaccgggttcgggaacctacggtacggtaccgtttacgggg

SEQ ID NO: 312904 - DNA, 601 bp, Homo sapiens
  misc_feature: GZ8MTXP02HE7Q1.52.53.E09.1.454.CMB.2.raw
  modified_base (186)..(186): a, c, t, g, unknown or other
  misc_feature (186)..(186): n is a, c, g, or t
  modified_base (207)..(207): a, c, t, g, unknown or other
  misc_feature (207)..(207): n is a, c, g, or t
  modified_base (257)..(257): a, c, t, g, unknown or other
  misc_feature (257)..(257): n is a, c, g, or t
  modified_base (353)..(353): a, c, t, g, unknown or other
  misc_feature (353)..(353): n is a, c, g, or t
  modified_base (600)..(601): a, c, t, g, unknown or other
  misc_feature (600)..(601): n is a, c, g, or t
tcagcgcagtacgacacgaccggtgctcgatttagagagagtgtgtgggtttgggggaggcttggtccagcctggtggttccctgagactctcctgtgcagcctctggattctccgtcagtagcaactacatgagctgggtccgccaggctccagggaagggctggagtgggtctcaagtctttangtcggtggtaccacatattangctgactcgtgaagggccattcaccatctccagagacgagtccaggaacngcctgttctcaaatggacagtctgagacctgacgacacggctgtctatactgtgcgagagaacccgagggggcggagcaccgaccccgtaattcgnggggccaacggggaacccgggtcaccggtctcccacgacgccctaccgaaccgaacgggcccacgtccgtcccttcccccgtcggcccacccctcctacccgaaacgacgccaccgtcggtacgggggcacgacggccggcccgtgggctcggccgtagggtaccaaagggtaccttaccgtttcctaacgtacgacgttccggactcgggacggccgggactgggacgaacgggctacgatacggnn

SEQ ID NO: 312905 - DNA, 573 bp, Homo sapiens
  misc_feature: GZ8MTXP02HAPEC.52.53.E09.1.454.CMB.2.raw
  modified_base (351)..(351): a, c, t, g, unknown or other
  misc_feature (351)..(351): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (572)..(573): a, c, t, g, unknown or other
  misc_feature (572)..(573): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattatgctgactcgtgaaggccattcacatctccagagacgagtccaggaacagcctgttctacaaatggacagtctgagacctgacgacacggctgtctattactgtgcgagacgaacccgagggggcgagcaccgcccgtaatcgnggggccaggggacccgcaccgtctccncagtcccncaaccgaaacggcccagtccgtccttcccccgtggccctacccctcctacccgaagacgccaccgtcggtcgggggaccacgacggccggcccgtcgggcctcgcccgtggtaccaaacggtacttaccttcctagtaaccgactccgcgtcgacggcgggctcggacaaacggccgataacgcgnn

SEQ ID NO: 312906 - DNA, 591 bp, Homo sapiens
  misc_feature: GZ8MTXP02IVDRY.52.53.E09.1.454.CMB.2.raw
  modified_base (330)..(330): a, c, t, g, unknown or other
  misc_feature (330)..(330): n is a, c, g, or t
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
  modified_base (590)..(591): a, c, t, g, unknown or other
  misc_feature (590)..(591): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtcttttatgtcggtggtaccacatattatgctgactccgtgaagggccattcaccatctccagagacgagtccaggaacagcctgtttctcaaatggacagtctgagacctgacgacacggctgtctattactgtgcgagagaacccgngggggcggagcacgcccccgtaatcgnggggccaggggaacccggtnaccgtctcctcacgccctcaccgaacgggcccacgtccggtccttcccccgtcggccctaccccctcctacccaaacgacgcctacgttccgtcgggggcaccgacggccgggcccgtcgggcctcggccgtagggtccgaaacggaccttaccgttacctacgtaccgactccgcgtcgacggcgggcgtcggacgaacggccgcagtacgnn

SEQ ID NO: 312907 - DNA, 575 bp, Homo sapiens
  misc_feature: GZ8MTXP02HWI5L.52.53.E09.1.454.CMB.2.raw
  modified_base (187)..(187): a, c, t, g, unknown or other
  misc_feature (187)..(187): n is a, c, g, or t
  modified_base (236)..(236): a, c, t, g, unknown or other
  misc_feature (236)..(236): n is a, c, g, or t
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (574)..(575): a, c, t, g, unknown or other
  misc_feature (574)..(575): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaagggctggagtgggtctcaagtctttangtcggtggtaccacatattatgctgactcgtgaaggccattcaccatcnccagagacgagtccaggacagcctgttctcaaatggacagtctgagacctgacgacacggctgtctattactgtgcgagagaacccgagggggccggancacgcccccgtaattcgnggggccacggggaacccggtcaccgtctcctcagccctaccaacccgaaacgggcccacgtccggtccttcccccgtggcccacccctcctcccaaacgacgccaccgtcgtcgggggcacgacggccgggccccgtggggcctcgcccgtggtccaaagggaccttaccttcctaattaccggatccgactcgagccggctgggccaagggcacactagnn

SEQ ID NO: 312908 - DNA, 497 bp, Homo sapiens
  misc_feature: GZ8MTXP02G69UD.52.53.E09.1.454.CMB.2.raw
  modified_base (184)..(184): a, c, t, g, unknown or other
  misc_feature (184)..(184): n is a, c, g, or t
  modified_base (293)..(293): a, c, t, g, unknown or other
  misc_feature (293)..(293): n is a, c, g, or t
  modified_base (329)..(329): a, c, t, g, unknown or other
  misc_feature (329)..(329): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (376)..(377): a, c, t, g, unknown or other
  misc_feature (376)..(377): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (387)..(388): a, c, t, g, unknown or other
  misc_feature (387)..(388): n is a, c, g, or t
  modified_base (390)..(390): a, c, t, g, unknown or other
  misc_feature (390)..(390): n is a, c, g, or t
  modified_base (423)..(423): a, c, t, g, unknown or other
  misc_feature (423)..(423): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggancctcggtcaagctcacctgcactctgagcagtgggcactacacctacgccatcgcatggcatcagctgcagccagagaagggccctggtacttgatggaaggctacaanagtgatggcagccacgagcgagggggacgtactccngatcgcttcgtcaggcctccggctcgtgggacngngcnctacncacnncncncncncnngngagagagagatatacgtgagagacgagacgagngtcgtagttggtcggtcggacgggacggacgtaacgtacgtaacgtacgtacgtacgacgaccgacgacgtccg

SEQ ID NO: 312909 - DNA, 612 bp, Homo sapiens
  misc_feature: GZ8MTXP02JH3H0.52.53.E09.1.454.CMB.2.raw
  modified_base (203)..(203): a, c, t, g, unknown or other
  misc_feature (203)..(203): n is a, c, g, or t
  modified_base (331)..(331): a, c, t, g, unknown or other
  misc_feature (331)..(331): n is a, c, g, or t
  modified_base (610)..(611): a, c, t, g, unknown or other
  misc_feature (610)..(611): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccaggggaaggggctggagtgggtctcaagtctttatgtcggtggtaccanatattatgctgactccgtgaagggccattcaccatctccagagacgagtccaggaacagcctgtttctcaaatggacagtctgacgacctgacgacacggctgtctattactgtgcgagagaacccgngggggcggagcacgccccgtaatcgcggggccacggggaacccggtcaccgtctcctcacgccctaccaccgaacgggcccagtcccggtccttcccccgtggcccacccctcctaccaagacgccacccgtcggtacgggggccaaccgcggcccgggtcccgtgggggttccgcccgtcgggtaccgaaacgggtaccttaccgttaccctaacgtacgtacgtccgccgtaggcggccgggtcgcgggaaccgaacgggccgacgtaagacggcgnng

SEQ ID NO: 312910 - DNA, 506 bp, Homo sapiens
  misc_feature: GZ8MTXP02GABN6.52.53.E09.1.454.CMB.2.raw
  modified_base (420)..(420): a, c, t, g, unknown or other
  misc_feature (420)..(420): n is a, c, g, or t
  modified_base (447)..(447): a, c, t, g, unknown or other
  misc_feature (447)..(447): n is a, c, g, or t
  modified_base (498)..(498): a, c, t, g, unknown or other
  misc_feature (498)..(498): n is a, c, g, or t
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaaggccctcggtacttgatgaggctcaacagtgatggcagccacgaggcgagggggaccgtatcccgtagatccgcttctcgaggcctccggctcgtgggactgagcgctactcacatctccagcctccgagtcctaggacggacgagggtgacttatcngtcagacgtggacagtgctagttgggngttcggaggtacgggacctaaggtcgacgtcgtaggtacacgcccgaggcncgtccccg

SEQ ID NO: 312911 - DNA, 542 bp, Homo sapiens
  misc_feature: GZ8MTXP02F7HGH.52.53.E09.1.454.CMB.2.raw
  modified_base (188)..(188): a, c, t, g, unknown or other
  misc_feature (188)..(188): n is a, c, g, or t
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttangtcggtggtaccacatattatgctgactccgtgaagggccattcaccatctccagagacgagtccaggaacagcctgttctcaaatggacagtctgacgacctgacgacacggctgtctatactgtgcgagagacccgngggggcgagcacgccccgtatcgnggggccaggacccngtcaccgtctccnacgcctaccaccgaacggcccagtccggtcccttccccgtcggcccaccctcctaccacgacgccaccctcgcggggacacgacggccgcccgtgggctcggcctggtacaacggctacgttctagtacgatcgctgacgcggcgtggacacggccgacanagn

SEQ ID NO: 312912 - DNA, 595 bp, Homo sapiens
  misc_feature: GZ8MTXP02IK8T0.52.53.E09.1.454.CMB.2.raw
  modified_base (202)..(202): a, c, t, g, unknown or other
  misc_feature (202)..(202): n is a, c, g, or t
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccanatattatgctgactcgtgaagggccattcaccatctccagagacgagtccaggaacagccttgttcttacaaatggacagtctgagacctgacgacacggctgtctattactgtgcgagacgaacccgagggggcggagcaccgccccgtaacttcgcggggccacggggaacccggtcaccgtctcctcgacgccctccaacgaacggcccagtccggtccttcccccgngccaccccgtccnccgaacgcgccaccgtcggtgggggaccacgacggccggccccgtggggccttcggcccgtgggtaccaacgggacttaccgtttccaagttaccggacttccggactggacggtccggggactcgggacgaacggcgacgactgcgcg

SEQ ID NO: 312913 - DNA, 570 bp, Homo sapiens
  misc_feature: GZ8MTXP02G3E2N.52.53.E09.1.454.CMB.2.raw
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (258)..(258): a, c, t, g, unknown or other
  misc_feature (258)..(258): n is a, c, g, or t
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
  modified_base (447)..(447): a, c, t, g, unknown or other
  misc_feature (447)..(447): n is a, c, g, or t
  modified_base (569)..(569): a, c, t, g, unknown or other
  misc_feature (569)..(569): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatggtcggtgtaccanatattangctgactccgtgaaggccattcaccatctcagagacgagtccaggaacngcctgttctcaaatggacagtctgagacctgacgacacggctgtctatactgtgcgagagaactcgagggggcganccagcccctaatcgngggccagggacccgggtnaccgtcacctcacgccctaccaacgaacgggcccaagtccggtcccttcccccgtggcccacccctcctaccaaggaccnccaccgtcggcgggacacgacggcccgtccgtcggctacgccgtaggtacgtaacgtaccttacgtacctaagtacgcgtacgcgtacgacggcggcggcggacgacggacgacgacgacgng

SEQ ID NO: 312914 - DNA, 516 bp, Homo sapiens
  misc_feature: GZ8MTXP02ISX8X.52.53.E09.1.454.CMB.2.raw
  modified_base (441)..(441): a, c, t, g, unknown or other
  misc_feature (441)..(441): n is a, c, g, or t
tcagcgcagtacgacacgaccggtgctcgatttagagagagtgtgttgggtttggggctgtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaacgcccggccacggcccctgtcttgcttattataagtactttgagagccctcacggacccctgacgcgacttctctggctccagctcagcgaacaacagtcaacgttcgaccatcagtgagtccagcagaggacgaggctagactatactgcagtcatcagacagcaagtgctacttanggtactagttcgggacggaacgggaaccctaaacgtcgtacccggtacgttacggaccacggacccaaggtcccg

SEQ ID NO: 312915 - DNA, 613 bp, Homo sapiens
  misc_feature: GZ8MTXP02G9IVC.52.53.E09.1.454.CMB.2.raw
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaaggccattcaccatctccagagacgagtccaggaacagcctgttctcaaatggacagtctgagacctgacgacacggctgtctattactgtgcgagagaacccgaggggcggancacgcccgtaatcgnggggccagggacccgggtcaccgtctcctcacgccctccgaaccgaacggggcccacgttccggtcccttcccccgtggccctaccccgtcctacccaagacgccaccgtccgtgggggccacgcgccgggcccgtggggcctcggcccgtgggtaccaaacgggtcctaaccgtttccaaagttaccggaacttccggcgttcggaacggccgggggtacttcgggggaccgaaaacggggccggactaaacggtacgcgcg

SEQ ID NO: 312916 - DNA, 567 bp, Homo sapiens
  misc_feature: GZ8MTXP02IACYX.52.53.E09.1.454.CMB.2.raw
  modified_base (144)..(144): a, c, t, g, unknown or other
  misc_feature (144)..(144): n is a, c, g, or t
  modified_base (200)..(200): a, c, t, g, unknown or other
  misc_feature (200)..(200): n is a, c, g, or t
  modified_base (351)..(351): a, c, t, g, unknown or other
  misc_feature (351)..(351): n is a, c, g, or t
  modified_base (423)..(423): a, c, t, g, unknown or other
  misc_feature (423)..(423): n is a, c, g, or t
  modified_base (566)..(567): a, c, t, g, unknown or other
  misc_feature (566)..(567): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccnccaggctccagggaaggggctggagtgggtctcaagtctttatgtcggtgtaccanatattatgctgactccgtgaagggccattcaccatctccagagacgagtccaggaacagcctgttctcaaatggacagtctgagacctgacgacacggctgtctattactgtgcgagagaacccgagggggcggagcacgccccgtaatcnggggcagggaaccccgggtcaccgtctcctcacgccctcaaccgaacgggcccagtccggtccttcccccgnggcccaccccgtcctaccaacgacgccaccctcgtcgggggcaacgcggcccgggccctggggcctcggcccgtggtaccgaaggtacctactttccataccgatccgactggacggcgggctgggccaagggcacagtacgnn

SEQ ID NO: 312917 - DNA, 560 bp, Homo sapiens
  misc_feature: GZ8MTXP02G3Z34.52.53.E09.1.454.CMB.2.raw
  modified_base (289)..(289): a, c, t, g, unknown or other
  misc_feature (289)..(289): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctnaaacagtgatggcagccacagcaggggggacgtatcccgngatcgcttcncgaggcctccgctcgagggacgtgagcgcctacctacaccactctccacgcctaccacgtcgtggaggacggagggtagtaactaattacttagtacgtacgacggtagggacgacgtacggtacgtaggtttagggttcgggttcgggtacggggtacggggaaccggtaacggttacgtaaccgtaccgtacggtacgtacgacccgaacggacgtccg

SEQ ID NO: 312918 - DNA, 598 bp, Homo sapiens
  misc_feature: GZ8MTXP02G4860.52.53.E09.1.454.CMB.2.raw
  modified_base (204)..(204): a, c, t, g, unknown or other
  misc_feature (204)..(204): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
  modified_base (597)..(597): a, c, t, g, unknown or other
  misc_feature (597)..(597): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgaggggaagggctgggagtgggtctcaagtctttatggtcggtggtaccanatattatgctgactccgtagaagggccattcaccatctccagagacgagtccaaggaacagccttgtttctacaaatggacagtctagacgacctgacgacacggctgtctattactgtgcgagacgacccggnggggcgagcacgcccgtatcgngggccagggacccgtnaccgtctcctacacgccctaccaccgaacgggcccagtccgtcctccccgtcgccaccctcctaccgaagacgccaccgtcgtgggggaccacgacggccggcccgtcgggcctcggccgtacgggtacctaaacgggtaccttaaccgttaccgtaacgtaccggaacttccggacgtcgacggccgggtcgtcgggacgaacggacgacgagtacggang

SEQ ID NO: 312919 - DNA, 532 bp, Homo sapiens
  misc_feature: GZ8MTXP02JEO21.52.53.E09.1.454.CMB.2.raw
  modified_base (337)..(337): a, c, t, g, unknown or other
  misc_feature (337)..(337): n is a, c, g, or t
  modified_base (375)..(375): a, c, t, g, unknown or other
  misc_feature (375)..(375): n is a, c, g, or t
  modified_base (516)..(516): a, c, t, g, unknown or other
  misc_feature (516)..(516): n is a, c, g, or t
  modified_base (531)..(532): a, c, t, g, unknown or other
  misc_feature (531)..(532): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccattcaccatctccagagacgagtccaggaacagcctgttctcaaatggacagtctgagacctgacgacacggctgctattactgtgcgagagaacccgagggggccggancacgcccccgtaatcgtggggccaggggaaccccggtnacccgtctcctcagcctccaccaagggcccatccggtcttccccctgccacccctcctccaagacgccaccgtcgtgggggcacgacgcggccctgggcctgactggtcaaggctactcctatacgactcgctgacgcggntggcaaggcgcatgnn

SEQ ID NO: 312920 - DNA, 567 bp, Homo sapiens
  misc_feature: GZ8MTXP02IG7MH.52.53.E09.1.454.CMB.2.raw
  modified_base (235)..(235): a, c, t, g, unknown or other
  misc_feature (235)..(235): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgccacagggtctctctcccagcctgtgctgactcaatccgccctctgcctctcgccctccctgggacncctcggtcaagctcacctgccactctgagcagtggcactacacctacgccatccgcagtggcatcagctgacagccagacgaacggccctaggtactgatgacgctanaacngtgatggcacgccagagcgggagggggtacgtacgtcccgtagacgtcgtctttccgcgacggtccgtccggtctcggtacgggactcgggacgcccgtactaccctccacctactcctccgacgtccctacgacgttccgaggacgggtaaccgtaggtacgtacttacgttacgcgtaacgacggtacggtcggaactacggtcggtacgtttacggg

SEQ ID NO: 312921 - DNA, 612 bp, Homo sapiens
  misc_feature: GZ8MTXP02H135H.52.53.E09.1.454.CMB.2.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (428)..(428): a, c, t, g, unknown or other
  misc_feature (428)..(428): n is a, c, g, or t
  modified_base (449)..(449): a, c, t, g, unknown or other
  misc_feature (449)..(449): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttatgtcggtggtaccanatattatgctgactccgtgaaggccattcaccatctccagagacgagtccaggaacngcctgtttctacaaatggacagtctgagacctgacgacacggctgtactattactgtgcgagacgaacccgagggggcggagcacgccccgtaatcgcggggcaggggaacccggtnaccgtntccctnacgccctaccaaccgacggcccagtccgtccttccccgngccacccctctaccaacgacnccaccgttcggcgggggaccacgacggccgggccccgtggggcctcggcccgtgggtaccgaaacgggtcctttaaacccgtttcctaaacgttaccgaacgttcccggacgttacggacggtccggggactcggggacaaacgggcccgactacgacgngng

SEQ ID NO: 312922 - DNA, 548 bp, Homo sapiens
  misc_feature: GZ8MTXP02JGBSZ.52.53.E09.1.454.CMB.2.raw
  modified_base (271)..(271): a, c, t, g, unknown or other
  misc_feature (271)..(271): n is a, c, g, or t
  modified_base (353)..(353): a, c, t, g, unknown or other
  misc_feature (353)..(353): n is a, c, g, or t
  modified_base (423)..(423): a, c, t, g, unknown or other
  misc_feature (423)..(423): n is a, c, g, or t
  modified_base (547)..(548): a, c, t, g, unknown or other
  misc_feature (547)..(548): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccattcaccatctccagagacgagtccaggaacagcctgtttctnaaatggacagtctgagacctgacgacacggctgtctattactgtgcgagacgacccgagggggcgagcacgccccgtatcgngggccagggacccggtcaccgtctccgtcacgcctacccaccaacgggccctatccggtccttcccccgnggccaccctcctaccaacgacgcacctcgtcgggggcacgacgccgggcctcgggcctcgccgtcggtacaaggactaccttacctataccgactcgctgacgcggctggcaacgcgcatacgnn

SEQ ID NO: 312923 - DNA, 567 bp, Homo sapiens
  misc_feature: GZ8MTXP02JMM58.52.53.E09.1.454.CMB.2.raw
  modified_base (200)..(200): a, c, t, g, unknown or other
  misc_feature (200)..(200): n is a, c, g, or t
  modified_base (327)..(327): a, c, t, g, unknown or other
  misc_feature (327)..(327): n is a, c, g, or t
  modified_base (377)..(377): a, c, t, g, unknown or other
  misc_feature (377)..(377): n is a, c, g, or t
  modified_base (416)..(416): a, c, t, g, unknown or other
  misc_feature (416)..(416): n is a, c, g, or t
  modified_base (565)..(566): a, c, t, g, unknown or other
  misc_feature (565)..(566): n is a, c, g, or t
tcagcgcagtacgacacgaccggtgctcgatttagagagagtgtgtgggtttgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccanatattatgctgactccgtgaagggccattcaccatctccagagacgagtccaggaacagcctgtttctacaaatggacagtctgagacctgacgacacggctgtctattactgtgcgagagaaccgnggggcggagcacgcccgtatcgcggggccagggacccgtcaccgtctccncacgccctccacgaacggcccacgtccgtccttccccgngccacccctcctaccgaagacgccaccgtcggtcgggggccacgacggccggcccgtgggcctcggccgtacggacgaaacggtaccttaccttacctacgtacgactcggcctaggacggccgggactgggacaacggcgacacgcgnng

SEQ ID NO: 312924 - DNA, 672 bp, Homo sapiens
  misc_feature: GZ8MTXP02I9AKE.52.53.E09.1.454.CMB.2.raw
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttccttgttgcttatttaaaggtgtccagtgtggagtgcaggtggtggagtcgtgggggagcttggtccagcctgggtcggttccctgagactctcctgtgcagcctctggattctccgtcagtagacaactacatgagcgtcgggtccgccgaggcctccggaaggggaacggggctagggagttggggtcctagtaagttcccttttaagtcgggttcggttacggtacccaagtaattagtttatcggtcctaggtaaccgttccggtaggaaaacgggggtccctatttacccacctaacgtccctacccgaagacgaacgacgtaccgaagggaacacgtccgttagtttacttaacgaaacgttggaactacgttcgacggtaacgaccgttacggaccgaccgtacgtcgttacgttaccttagtttactaggtacgaacgtacggaaccggaaccggcggggggacggacgaccggtaccggacccccggttaattcccggggg

SEQ ID NO: 312925 - DNA, 575 bp, Homo sapiens
  misc_feature: GZ8MTXP02IH7RV.52.53.E09.1.454.CMB.2.raw
  modified_base (209)..(209): a, c, t, g, unknown or other
  misc_feature (209)..(209): n is a, c, g, or t
  modified_base (316)..(316): a, c, t, g, unknown or other
  misc_feature (316)..(316): n is a, c, g, or t
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
  modified_base (574)..(575): a, c, t, g, unknown or other
  misc_feature (574)..(575): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattangctgactccgtgaaggccgattcaccatctccagagacgagtccaggaacagccttgtttctcaaatggacagtctgagacctgaacgacacgggctgtctattacngtgcgagagaacccgagggggcgagcacgccccgtaatcgnggggccaggggacccggtcaccgtctccncacgcctccaacaacgggcccacgtccggtcccttcccccgtcggacccacccctcctacccaaacgacgccgaaccttccgcgggggaccacgacggccgggccctggggcctcggccgtcggtcaaacggtactaacttcctactacgactcgactcgacgcggctggacaacggcgacactacgnn

SEQ ID NO: 312926 - DNA, 605 bp, Homo sapiens
  misc_feature: GZ8MTXP02JUS4F.52.53.E09.1.454.CMB.2.raw
  modified_base (240)..(240): a, c, t, g, unknown or other
  misc_feature (240)..(240): n is a, c, g, or t
  modified_base (359)..(359): a, c, t, g, unknown or other
  misc_feature (359)..(359): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagttctttatggtcggtggtaccacatattatgctgactcgtgaagggccattcacatcnccagagacgagtccaaggaacagccttgtttcttcaaatggacagtctgagacctgacgacacggctgtctattactgtgcgagagaacccgagggggcgagcacgccccgtaattcgnggggccgagggaacccgggtcaccgtctcctcacgccctccaaccgacggcccagtccgtcctcccccgtggccctacccctcctaccgaacgacgcctaccgtcgtacgggggccacgacggccggcccgtgggccctcggcccgttgggtaccgtaaacgggtaccttaacccgtttaccgtaacgttaaccgacgttccgcgtgaccggtcgggcctcgggacgaacggcgacctagacgngn

SEQ ID NO: 312927 - DNA, 534 bp, Homo sapiens
  misc_feature: GZ8MTXP02JIWE1.52.53.E09.1.454.CMB.2.raw
  modified_base (291)..(291): a, c, t, g, unknown or other
  misc_feature (291)..(291): n is a, c, g, or t
  modified_base (461)..(461): a, c, t, g, unknown or other
  misc_feature (461)..(461): n is a, c, g, or t
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacngtgatggcagccacagcgagggggaccgtatcccgtgatcgcttctcgaggctccggctcgtggggactggagcgctacctcaccatcctccagccctcgagtctggaggaccggagggttcgacttattaccgtgtcgagtacgtgggacacgtggctagtttcggggngttcgggacggggacgggaccgtaaggttcgaccgtcgtaacgggtcacggcccaaggtccgtcggtcccccg

SEQ ID NO: 312928 - DNA, 541 bp, Homo sapiens
  misc_feature: GZ8MTXP02GRKTN.52.53.E09.1.454.CMB.2.raw
  modified_base (355)..(355): a, c, t, g, unknown or other
  misc_feature (355)..(355): n is a, c, g, or t
  modified_base (426)..(426): a, c, t, g, unknown or other
  misc_feature (426)..(426): n is a, c, g, or t
  modified_base (450)..(450): a, c, t, g, unknown or other
  misc_feature (450)..(450): n is a, c, g, or t
  modified_base (525)..(525): a, c, t, g, unknown or other
  misc_feature (525)..(525): n is a, c, g, or t
  modified_base (536)..(536): a, c, t, g, unknown or other
  misc_feature (536)..(536): n is a, c, g, or t
  modified_base (540)..(541): a, c, t, g, unknown or other
  misc_feature (540)..(541): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccaggtaaggggctggagtgggtctcaagtctttatggtcggtggtaccacatattatgctgactccgtgaagggccattcaccatctccagagacgagtccaggaacagcctgttctcaaatggacagtctgagacctgacacacggctgtctattactgtgcgagacgaacccgagggggcggagcacgccccgtaattcgnggggccaggggacccggtcaccgtctccgcacgcctccaaccgaacgggcccagtccggtccttcccccgnggccacccctccacccgaaagacnccacctcgtaggggcacgacgccggccctgggctgccgtgtcaaggctacttcctatacgctcgctgacgcggtnggcaaggccanagann

SEQ ID NO: 312929 - DNA, 626 bp, Homo sapiens
  misc_feature: GZ8MTXP02HWPB5.52.53.E09.1.454.CMB.2.raw
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagaggaacgggcctcggtacttgatgaggctcaacagtgatggcagccacgagcgacgggggacgtatcccgtgatccgcttcctcgaggcctccggctcgtgggactgacgcgctacctcaccatcctacacgccctaccgagtccgtaggaacgggacgggtaagggtcgtaaaccttagttaaccgtggtacctaagggaacggttacgggggaactaacggttcgggaccgtttaagggttttgggggttcggtttaccgggggacggggtaacgggggtaaccccttaaaagggttccggtaaaaccccgggtttccgtaaaggggtacccaccggtacccccgaaggggtccctacccccggg

SEQ ID NO: 312930 - DNA, 583 bp, Homo sapiens
  misc_feature: GZ8MTXP02HONVU.52.53.E09.1.454.CMB.2.raw
  modified_base (205)..(205): a, c, t, g, unknown or other
  misc_feature (205)..(205): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (445)..(445): a, c, t, g, unknown or other
  misc_feature (445)..(445): n is a, c, g, or t
  modified_base (466)..(466): a, c, t, g, unknown or other
  misc_feature (466)..(466): n is a, c, g, or t
  modified_base (561)..(561): a, c, t, g, unknown or other
  misc_feature (561)..(561): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagtctttatggtcggtggtaccanatattangctgactcgtgaagggccattcacatcnccagagacgagtccaaggaacagccttgtttctacaaatggacagtctgagacctgacgacacggctgtctattactgtgacgagacgaacccggagggggcggagcacccgccccgtaagttcgcggggccgaacggggaccccggtcaccgtctcctcgacgtcccaccgaaccgaacggcccagtccggtcccttcccccgngcccacccctcctaccaagcnccaccgtcggtcggggccacgacggccggcccgtgggcctcgccgtggtaccaaggtcctacttccagtacgactccgctcggacggcgggtacngggacgaacggccanagngnng

SEQ ID NO: 312931 - DNA, 545 bp, Homo sapiens
  misc_feature: GZ8MTXP02FQBTE.52.53.E09.1.454.CMB.2.raw
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaaggccctggtacttgatgaggctacaacagtgatggcagccagagcgacgggggacgtactcccgtgatcgcttctcgaggtcctccggctcgtgggactgacgcgctacctcaccatcctcacgtcctccagtccgtagaaggacgagggtctaactattaccgtgtaccaggacgtgggacacgtggtactaggtttggggtcgttcggggacgggtacgggacctaaacggttcggaacccgttccgtaggtaccgacgacccgaaacggcgtccccgg

SEQ ID NO: 312932 - DNA, 617 bp, Homo sapiens
  misc_feature: GZ8MTXP02FH7L7.52.53.E09.1.454.CMB.2.raw
  modified_base (240)..(240): a, c, t, g, unknown or other
  misc_feature (240)..(240): n is a, c, g, or t
  modified_base (362)..(362): a, c, t, g, unknown or other
  misc_feature (362)..(362): n is a, c, g, or t
  modified_base (400)..(400): a, c, t, g, unknown or other
  misc_feature (400)..(400): n is a, c, g, or t
  modified_base (433)..(433): a, c, t, g, unknown or other
  misc_feature (433)..(433): n is a, c, g, or t
  modified_base (616)..(616): a, c, t, g, unknown or other
  misc_feature (616)..(616): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccaggggaaggggctggagtgggtctcaagttctttatgtcggtggtaccacatattatgctgactcgtgaagggccattcaccatcnccagagacgagtccaggaacagcctgtttctcaaatggacagtctgagacctgacgacacggctgtctaattactgtgcgagacgaaaccccgagggggcggagcacgtcccccgtaatcgnggggccaggggacccgggtcacccgtctccgtcagccnccaacaaacgggcccagtccgtccttcccccgngcccacccctcctaccaaagacgcctacccgtcgcgggggacacgacgcccgggccgttcggggctcgtcccgttcgaccgaaacggtaccttaacctttacctaacgttaccggaacttccgggaccttacggacggccggggccggtcgggacggaaacggccggaccgaaacgtacgcgng

SEQ ID NO: 312933 - DNA, 549 bp, Homo sapiens
  misc_feature: GZ8MTXP02GLPN6.52.53.E09.1.454.CMB.2.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
  modified_base (548)..(549): a, c, t, g, unknown or other
  misc_feature (548)..(549): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattangctgactccgtgaagggccattcaccatctccaganacgagtccaggaacagcctgttctcaaatggacagtctgagacctgacgacacggctgtctattactgtgcgagagaacccgagggggcggagcacgcccccgtaatcgnggggccaggggaacccggtcaccgtctccncagccctccaccaacgggcccatccgtccttccccctcggcccaccctccctcccaacgacgccacctcgtcgggggcacgacgccgggccctcgggcctgccctggtccaaggactacgttcctatacgactcgctcgacgcgggctggcaaggcgcatacgnn

SEQ ID NO: 312934 - DNA, 513 bp, Homo sapiens
  misc_feature: GZ8MTXP02JQL6U.52.53.E09.1.454.CMB.2.raw
  modified_base (363)..(363): a, c, t, g, unknown or other
  misc_feature (363)..(363): n is a, c, g, or t
tcagcgcagtacgacacgaccggtgctcgatttagagagagtgtgttgggtttgggggctgtgggtccaggaggcagaactctgggtgtctcaccatggcctggatccctctacttctcccctcctcactctctgcacaggctctgaggcctcctatgagctgacacagccaccctcggtgtctgtgtcctcaggacagacgccaggatcacctgctctggagatgcattgaccaaagcaatatgcttactggtaccagcagaacgccgcaggcccctgtcttgctttattataaagctttgagacggcctacgacgggacccctgacgcgacttctcgtcgctccagctcacgcgaacaacngtacacgttcgaccatcgagtggagtccgagcaggaggacgagctagacttatactgtacagtcagtcagacagtcagtgctacttgtgtcgtagttcggacggacggaactaaacgtcgaccgtacgttacgcacgccgaacggtcccg

SEQ ID NO: 312935 - DNA, 537 bp, Homo sapiens
  misc_feature: GZ8MTXP02GVLRB.52.53.E09.1.454.CMB.2.raw
tcagcgcagtacgacacgaccggtgctcgatttagagagagtgtgttgggtttgggggctgtgggtccaggaggcagaactctgggtgtctcaccatggcctggatccctctacttcctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaacgccccggcacggcccctgtcttgtcttatttaataaaagactttgagacggccctacgacggacccctgacgcgacttctctcggctccagctcagcgaacaacagtcacgttcgaaccatcgaagtcggataccgagcgaagaggacgagctagacttattacgtgctagtcatacagaacagacgtagtgactacttattggtacgtagttcgggacggacgggtaaccaaacgtcgaacccgtcgtacgcacgacccgaagtcccg

SEQ ID NO: 312936 - DNA, 609 bp, Homo sapiens
  misc_feature: GZ8MTXP02GQ3ZQ.52.53.E09.1.454.CMB.2.raw
tcagcgcagtacgacacgaccggtgctcgatttagagagagtgtgttgggtttggggagctctgggagtctgcaccatggcttggaccccactcctcttcctcaccctcctcctccactgcacagggtctctctccagcctgtgctgactcaatcgccctctgcctctgccctccctgggagcctcggtcaagctcacctgcactctgagcagtggcactacactacgccatcgcatggcatcagctgcagccagagaacggccctggtactgatgaggctacaacagtgatggcagccacgagcggagggggaccgtagtcccgtgactcgcttctcgacggctcggctcgtggactgacgccgacctacccacacctacgtccacccgacgccctacgaacgttccgagggaacgggaaccggtaaggggttactaaacgtttaacgtacgttacgtaccgaacggtacccgggttagggaacccgtaacggtgaccgtttaaggggtttcgggttcgggttaccgggacgggtaacggtaaacgtacggttaccgacccggtaagttacggacgaaccgacccgtaacggcctacccgtcccccgg

SEQ ID NO: 312937 - DNA, 634 bp, Homo sapiens
  misc_feature: GZ8MTXP02ID4EA.52.53.E09.1.454.CMB.2.raw
  modified_base (184)..(184): a, c, t, g, unknown or other
  misc_feature (184)..(184): n is a, c, g, or t
  modified_base (347)..(347): a, c, t, g, unknown or other
  misc_feature (347)..(347): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggancctcggtcaagctcacctgcactctgagcagtggcactacacctacgccatcgcatggcatcagctgcagccagagaacggcctggtactgatgagctacaacagtcagtggacagcccaagaggacggacggggggacgtacgtcccgtgacgtcgtcttcncgaggtccgtccggctcgtaggactgacgcgcctacctcacctatcctcacgcctccagtccgtaggacgggacggtagggtagtaaccgtattacgtacggtacgtacggtacggttacggacgtaaccggtagggtccgtttaagggttttcgggggtacggtttaccgggggacggggtaaccggggtaacccgttaagggtttacccggtaaacccgggtttcccggttaacgggtaccggaaccggttacccccggaaaaggttccccggttccccccgggg

SEQ ID NO: 312938 - DNA, 595 bp, Homo sapiens
  misc_feature: GZ8MTXP02HMAOO.52.53.E09.1.454.CMB.2.raw
  modified_base (394)..(394): a, c, t, g, unknown or other
  misc_feature (394)..(394): n is a, c, g, or t
  modified_base (593)..(594): a, c, t, g, unknown or other
  misc_feature (593)..(594): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagtctttatgtcggtggtaccacatattatgctgactccgtgaaggccgattcaccatctccagagacgagtccaaggaacagccttgtttctacaaatggacagtctgagacctgaccgacacggctgtctattactgtgacgagacgaaacccgagggggcggagcgacgcccccgtaattcgcggggccaacgggacccggtcaccgtcncctcacgcctaccaccgaacgggcccaacgtccgtacccttcccccgtggcccacccctcctaccaacgacgccacctccggtgggggccacgacggcccgggccccgtgggcctcggacccgtcggtaccaaaggtcctaaccgttcctaagtaccgatccgacgtgacggccgggctcgggcaacggcgacagtcgnng

SEQ ID NO: 312939 - DNA, 643 bp, Homo sapiens
  misc_feature: GZ8MTXP02ICQSF.52.53.E09.1.454.CMB.2.raw
tcagcgcagtacgacacgaccggtgctcgatttagagagagtgtgttgggtttggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctcgtggagatgcattgaccaaaagcaaatatgtcttactggtaccagcagaacgccccggcacggcccctgtcttgtctttattaataaagctttagagtacgcctacgacggacccctgagcgtacttcctcgtggcctcagcctcgacgcgaacaaacgtacgtaccgtacggttacaaccctagtccgtaagttcgggaacggttacccgagggaccgaaggtaacggggaacggaacgggctacgggtaaacctttaacgtttaacgttgtttacgacgttaccaattaccgaagggaacaacgggtcaagggttcgacttaacgtttaagttcggtacgtttacggttccgggacgggaaccgggtaccaaacggtccgtaaccgtacgttacggtaccaaccggaccgtaacggtccccg

SEQ ID NO: 312940 - DNA, 604 bp, Homo sapiens
  misc_feature: GZ8MTXP02J0UBO.52.53.E09.1.454.CMB.2.raw
  modified_base (303)..(303): a, c, t, g, unknown or other
  misc_feature (303)..(303): n is a, c, g, or t
tcagcgcagtacgacacgaccggtgctcgatttagagagagtgtgttgggtttgggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaacgccccggccacggcccctgtcttgtctttatttaanaaagtactttggagacggccctcgacgggacccctgacgcgacttctcgtggctccagtctcgagccgaacaacgagtacgtaacgttcgaaccctataccgaggttacgggacgtcccgagggaccaaggacgggacgagggtctaggacttagttacgtgtacagttacatcgaagacgcgacgtagtcggacttacgttagtcggttacggttagttccggggacgggtaaccgggtaacccaaaacggtccgtaacccgttccgtacgggtaccaccggaccccgaaggggtccccg

SEQ ID NO: 312941 - DNA, 604 bp, Homo sapiens
  misc_feature: GZ8MTXP02HC7IW.52.53.E09.1.454.CMB.2.raw
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (492)..(492): a, c, t, g, unknown or other
  misc_feature (492)..(492): n is a, c, g, or t
  modified_base (601)..(601): a, c, t, g, unknown or other
  misc_feature (601)..(601): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaagggctggagtgggtctcaagtctttatgtcggtgtaccanatattangctgactcgngaaggccattcaccatcncagagacgagtccaggaacngcctgtttctcaaatggacagtctgacgacctgaccgacacggctgtactattactgtgcgagacgaacccgnggggcggancaccgcccgtatcgcggggccacggggacccggtcaccgtctccgtcacgccctaccgaccgaacggcccacgtccgtcccttccccgcgccacccctccctaccaacgtacgcctacccgtcggtcgggggccaccgacggcccggtcccgngggcctcggtccgtaggtaccaacggtacctaccctttaccgacgtaccgactcggcctacgggacggtccgggcgtcggggaccgtaacgggccgacgaacgtacggngcg

SEQ ID NO: 312942 - DNA, 564 bp, Homo sapiens
  misc_feature: GZ8MTXP02IMTBB.52.53.E09.1.454.CMB.2.raw
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (383)..(383): a, c, t, g, unknown or other
  misc_feature (383)..(383): n is a, c, g, or t
  modified_base (444)..(444): a, c, t, g, unknown or other
  misc_feature (444)..(444): n is a, c, g, or t
  modified_base (482)..(482): a, c, t, g, unknown or other
  misc_feature (482)..(482): n is a, c, g, or t
  modified_base (543)..(543): a, c, t, g, unknown or other
  misc_feature (543)..(543): n is a, c, g, or t
  modified_base (561)..(561): a, c, t, g, unknown or other
  misc_feature (561)..(561): n is a, c, g, or t
  modified_base (563)..(564): a, c, t, g, unknown or other
  misc_feature (563)..(564): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatggtcggtggtaccacatattangctgactccgtgaagggccattcaccntctccagagacgagtccaaggaacagccttgttctcaaatggacagtctganacctgacgacacggctgtctattactgtgcgagagacccgnggggcggancacgccccgtattcgaggggcacggggacccgtcaccgtctccncgacgcctaccaacgaacggcccagtccgtccttccccctggtacccctcctacaacgacnccaccgtcggtcgggggcacgacgccggccctggggcncggaccgtggtacaaaggtacctaccttacctacgtacgatccgacgtcggacgcgggtcngggcgaacggcgacagcncnn

SEQ ID NO: 312943 - DNA, 580 bp, Homo sapiens
  misc_feature: GZ8MTXP02JQV3C.52.53.E09.1.454.CMB.2.raw
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (464)..(464): a, c, t, g, unknown or other
  misc_feature (464)..(464): n is a, c, g, or t
  modified_base (561)..(561): a, c, t, g, unknown or other
  misc_feature (561)..(561): n is a, c, g, or t
  modified_base (579)..(580): a, c, t, g, unknown or other
  misc_feature (579)..(580): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccaggtaaggggctggagtgggtctcaagtctttatgtcggtggtaccacatattatgctgactcgtgaaggccattcaccatctccagagacgagtccaggaacagcctgttctacaaatggacagtctgagacctgacgacacggctgtctattactgtgacgagacgaacccggngggggcggancgacgcccccgtaagttcgcgggggaccaacggggacccggtcacccgtctccctcgacgtccctccgaaccgaacgggcccagtcccggtccttcccccgtggcccacccctcctaccaagcnccaccgtcggtcggggcacgacggccgggcccgtgggctcggccgtcggtacaacggtactaccttacctataccgatccgcgtggacggcgggtcnggacgaacggcgacagcnn

SEQ ID NO: 312944 - DNA, 592 bp, Homo sapiens
  misc_feature: GZ8MTXP02G3PLA.52.53.E09.1.454.CMB.2.raw
  modified_base (201)..(201): a, c, t, g, unknown or other
  misc_feature (201)..(201): n is a, c, g, or t
  modified_base (325)..(325): a, c, t, g, unknown or other
  misc_feature (325)..(325): n is a, c, g, or t
  modified_base (383)..(383): a, c, t, g, unknown or other
  misc_feature (383)..(383): n is a, c, g, or t
  modified_base (496)..(496): a, c, t, g, unknown or other
  misc_feature (496)..(496): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgagggaagggctggagtgggtctcaagtctttatgtcggtggtaccanatattatgctgactccgtgaaggccattcacatctcagagacgagtccaggaacagcctgtttctcaaatggacagtctagacgacctgacgcacggctgtctatactgtgcgagagaacccgnggggcgagcacgccccgtaatcgcggggccacggggacccggtcaccgtctccgtacncgccctccgaccgtaaacgggcccacgttcccggtcccttcccccgtggtcccaccccgttccctacgaaacgacgcctaccgtcggtcgggggcacgacggccggtccccgnggcctcggccgtggaccgaaggtaccttacttacctacgtacgacgtccgacgtcgacggtcggccgtgggacccaagggccgacgtacacggngn

SEQ ID NO: 312945 - DNA, 568 bp, Homo sapiens
  misc_feature: GZ8MTXP02G8L9X.52.53.E09.1.454.CMB.2.raw
  modified_base (310)..(310): a, c, t, g, unknown or other
  misc_feature (310)..(310): n is a, c, g, or t
  modified_base (376)..(376): a, c, t, g, unknown or other
  misc_feature (376)..(376): n is a, c, g, or t
tcagcgcagtacgacacgaccggtgctcgatttagagagagtgtgttgagtttggggagctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtcgtgggggagcgttggtccagcctggtggttccctgagactctcctgtgcagcctctggattctccgtcagtacgcaactacatgagcgtgggtcccnccgaggcctccgaggggaaggggctgggagtggtctgaagttctttagtggtcggtcgtaccactntattatgcttgactccggtagacggggccacgttcacctatcctacacgagacgacgtaccgaagaaacacgtccttgtttctactaaagtgaaacctgtactacgaacgccgttagaccgacgacgtcttgtacttattacgtgtacgcgtaagaacgaccggagggggccgagccgaccgcccgttaacg

SEQ ID NO: 312946 - DNA, 550 bp, Homo sapiens
  misc_feature: GZ8MTXP02IUBLS.52.53.E09.1.454.CMB.2.raw
  modified_base (314)..(314): a, c, t, g, unknown or other
  misc_feature (314)..(314): n is a, c, g, or t
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (533)..(533): a, c, t, g, unknown or other
  misc_feature (533)..(533): n is a, c, g, or t
  modified_base (543)..(543): a, c, t, g, unknown or other
  misc_feature (543)..(543): n is a, c, g, or t
  modified_base (549)..(550): a, c, t, g, unknown or other
  misc_feature (549)..(550): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccaggtaaggggctggagtgggtctcaagtctttatgtcggtggtaccacatattatgctgactccgtgaagggccattcaccatctccagagacgagtccaggaacagccttgtttctcaaatggacagtctgagacctgacgacacggctgtctattacngtgcgagacgaacccgagggggcgancacgcccctatcgnggggccagggacccgtnaccgtcncctcacgcctaccaccaacggggcccagtccggtccttccccctggccctacccctctacccaaagacgcacctcggtgggggccaacgcggccggcccgtgggctcgcccgttggacaaaggcttaccttccataacgctcgctggacgcggcnggcaaggccntaagann

SEQ ID NO: 312947 - DNA, 544 bp, Homo sapiens
  misc_feature: GZ8MTXP02JCEW7.52.53.E09.1.454.CMB.2.raw
  modified_base (445)..(445): a, c, t, g, unknown or other
  misc_feature (445)..(445): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgccctccctgggagcctcggtcaagctcacctgcactctgagcagtgggcactacacctacgccatcgcatggcatcagctgcagccagagaaggccctcggtacttgatgaggctcaacagtgatggcagccacaggcgaggggggacgtatcccgtgactcgcttctcacggctccggctcgtgggactgacgcgctaacctcacatcctcacgcctacagttccgaggaggacgtagggtacgtacttattactgtcaggacggtggaacncgtggactggtttggggtcgttcgggacgggtacgggtaccgtaaggtttcggaacccgttccgtacgggtccacggtcccgaacgggccttcccccgg

SEQ ID NO: 312948 - DNA, 502 bp, Homo sapiens
  misc_feature: GZ8MTXP02G3RF1.52.53.E09.1.454.CMB.2.raw
  modified_base (186)..(186): a, c, t, g, unknown or other
  misc_feature (186)..(186): n is a, c, g, or t
  modified_base (308)..(308): a, c, t, g, unknown or other
  misc_feature (308)..(308): n is a, c, g, or t
  modified_base (332)..(332): a, c, t, g, unknown or other
  misc_feature (332)..(332): n is a, c, g, or t
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgccctccctggggancctcggtcaagctcacctgcactctgagcagtggcactacacctacgccatcgcatggcatcagctgcagccagagaacggcctcggtacttgatgaggctacaacagtgagtggcagccanaggcgacgggggacgtactcccgngactcggcttctcgaggccgtccgctcgtgggactgacgcgactacctcacatcctcagcctcagtcngaggacgagggtnatatacgtgtacgagacgtggacacgtggctagttggtcgttcggacggacggaccaggtcgaacgtcgaggtcagccaaggctacccg

SEQ ID NO: 312949 - DNA, 530 bp, Homo sapiens
  misc_feature: GZ8MTXP02F4DV1.52.53.E09.1.454.CMB.2.raw
  modified_base (355)..(355): a, c, t, g, unknown or other
  misc_feature (355)..(355): n is a, c, g, or t
  modified_base (377)..(377): a, c, t, g, unknown or other
  misc_feature (377)..(377): n is a, c, g, or t
  modified_base (459)..(459): a, c, t, g, unknown or other
  misc_feature (459)..(459): n is a, c, g, or t
  modified_base (529)..(530): a, c, t, g, unknown or other
  misc_feature (529)..(530): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgagggaaggggctggagtgggtctcaagtctttatggtcggtggtaccacatattatgctgactccgtgaagggccattcaccatctccagagacgagtccaggaacagcctgttctcaaatggacagtctgagacctgacgacacggctgtctattactgtgcgagagaacccgagggggcggagcacgccccgtaatcgnggggccaaggggaacccgggtnaccgtctcctcagccctcaccaacgggcccatcggtcctcccctgccacccgtcctccaagacgcacctcgtgggggcacgngcggccctgggctgcctggtcaaggactactcctatcgactcgctgacgcgggctggcaaggcgcatagnn

SEQ ID NO: 312950 - DNA, 576 bp, Homo sapiens
  misc_feature: GZ8MTXP02F8NX1.52.53.E09.1.454.CMB.2.raw
  modified_base (354)..(354): a, c, t, g, unknown or other
  misc_feature (354)..(354): n is a, c, g, or t
  modified_base (575)..(576): a, c, t, g, unknown or other
  misc_feature (575)..(576): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattatgctgactccgtgaaggccattcaccatctccagagacgagtccaggaacagcctgttctcaaatggacagtctgagacctgacgacacggctgtctattactgtgcgagagaaacccgagggggcggagcacgcccccgtaattcgnggggccaggggaacccggtcaccgtctactcagcctccaccaagggcccactccggtccttcccccgtcggccaccccgtccctacccaagacgcctaacccgtcgtcgggggccacgacggccgggcccgtcggggcctcggcccgttggccgaaacgggtactttaccttacctaactaccgacttcgcgtgacgcggcgtggcgaacggcgcactagnn

SEQ ID NO: 312951 - DNA, 555 bp, Homo sapiens
  misc_feature: GZ8MTXP02FODJN.52.53.E09.1.454.CMB.2.raw
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgcacagggtctctctcccagcctgtgctgactcaatccgccctctcgcctctcgccctcccgtgggacgcctcggtcaagctcacctgcactctgagcagtggcactacacctacgccatcgcagtggcatcagctgcagccagacgaacggcctaggtactgatgagctacaacgagtgagtcggcacgccagtaggcggagggggacgtacgtcccgtagactcgtctcgtacgacggcctccggcgttacgtacgggactggactccggactacctccaccgactcctcacgccctcacgtcctaggacgaacggtcgggtactacgtacgttacgtcgtaacgaacggtacggtacggggactacggtaggtcgtttaacgggg

SEQ ID NO: 312952 - DNA, 554 bp, Homo sapiens
  misc_feature: GZ8MTXP02F0SSH.52.53.E09.1.454.CMB.2.raw
  modified_base (203)..(203): a, c, t, g, unknown or other
  misc_feature (203)..(203): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (553)..(553): a, c, t, g, unknown or other
  misc_feature (553)..(553): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttatgtcggtggtaccanatattatgctgactcgtgaagggccattcaccatctccagagacgagtccaggaacagcctgttctacaaatggacagtctgagacctgacgacacggctgtctattactgtgcgagacgaacccgngggggcgancacgcccgtatcgngggcagggaccgtnaccgtcnccncagcctcacacgccagtcgtcctcccngccnccctcncagcgcacgtcgtggggcacgcgccggcctcgggctcgccgtggtaccgaacggtaccttaccgttacctaagtaccgtactccggcgttcggacggccgggtcgtcgggaccgaaacgggcccgataacggtacgcgng

SEQ ID NO: 312953 - DNA, 651 bp, Homo sapiens
  misc_feature: GZ8MTXP02I4HEV.52.53.E09.1.454.CMB.2.raw
  modified_base (316)..(316): a, c, t, g, unknown or other
  misc_feature (316)..(316): n is a, c, g, or t
  modified_base (340)..(340): a, c, t, g, unknown or other
  misc_feature (340)..(340): n is a, c, g, or t
tcagcgcagtacgacacgaccggtgctcgatttagagagagtgtgttgggtttgggagctctgggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcagtggcatcagctgcagccaggagtaaggcccgtcggttacttgatgaggcttacaacaggtgatgggcagccacgcggnggtaacggggggtcgtacgtcccngtatcgtcttccgtcgtagggcccgttccgggtccgttcgtacgggggtacttcggtaacgaccggtccgttacccgtaccctaacccgtaacccttcctaccccgtaaccgtcccgtcccctaaccgtccgttaacggacggggtaaccgggtaacgggtacggtaagtacccccgtttaagtaccgttacgacgtacggtacgggtacgtaccgtaggtcgtaggttcgggttggttcgggtacggggtacggtacgggtacgtacggtacgtcgtacggtcgacggtaccgacggtcgtcgtccccgg

SEQ ID NO: 312954 - DNA, 591 bp, Homo sapiens
  misc_feature: GZ8MTXP02H2M79.52.53.E09.1.454.CMB.2.raw
  modified_base (310)..(310): a, c, t, g, unknown or other
  misc_feature (310)..(310): n is a, c, g, or t
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtcgtgggggaggcttggtccagcctggtcggttccctgagacttctcctgtgcacgcctctggattctccgtcagtagcaactacatgagcgtgggccnccgaggctccgaggggagggctgggagtgggtctcgaagttcctttagtgtcggtaggtacccatattnttatgctagacttccgngaaacgggcctatccaccatcaccagacgacgacgtccaggaacacgtccttgtttacctagaaaacgtggaacagttcagtacgacctgaaccgacacggcttaggttacctaaattcgtagtcgacgtaaggaaacgaacccgggaggggggaccggacgtacccgaccggtacccccgttaacttccggggg

SEQ ID NO: 312955 - DNA, 588 bp, Homo sapiens
  misc_feature: GZ8MTXP02JZ79V.52.53.E09.1.454.CMB.2.raw
  modified_base (376)..(376): a, c, t, g, unknown or other
  misc_feature (376)..(376): n is a, c, g, or t
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaaggccctcggtacttgatgaggctcaacagtgatggcagtcacagcgagggggaccgtatccctgactcgcttcgtcgagccgtccggctcgtgggactggagccgctacccgtnacccagtcctccagtccctcgagtcgtggacggaccggaagggtcgtaccttagtttaacgcgttacgacggtacggtcggaactcgtcgggtactagggtttggggtcggttacggggcgggtaacgggtacccgtaaagggtttccggaacccggttcgttaacgggtaccgacgggacccccgttaagggcccgtacggtcccccccgg

SEQ ID NO: 312956 - DNA, 531 bp, Homo sapiens
  misc_feature: GZ8MTXP02FSGPB.52.53.E09.1.454.CMB.2.raw
  modified_base (307)..(307): a, c, t, g, unknown or other
  misc_feature (307)..(307): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (408)..(408): a, c, t, g, unknown or other
  misc_feature (408)..(408): n is a, c, g, or t
  modified_base (487)..(487): a, c, t, g, unknown or other
  misc_feature (487)..(487): n is a, c, g, or t
  modified_base (506)..(506): a, c, t, g, unknown or other
  misc_feature (506)..(506): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttccttgttgctatttaaaaggtgtccagtgtggagtgcaggtggtggagtcgtgggggaggcttggtccagcctggtggttccctgagactctcctgtgcagcctctggattctccgtcagtagcaactacatgagcgtgggtccnccaggctccgaggggaagggctgggagtggggtctacgaagttcctttagtgtcggtgtaccacattntangctgactcgtagaacggccattccacatcncagagacgagtccaaggacagccttgtttactacaaatggacagtctgacgacctgaacgacaggctgtactattacgngtcgacgagacgaaccggngggggcgacgcacgccccgtatcgg

SEQ ID NO: 312957 - DNA, 619 bp, Homo sapiens
  misc_feature: GZ8MTXP02IVRYG.52.53.E09.1.454.CMB.2.raw
  modified_base (333)..(333): a, c, t, g, unknown or other
  misc_feature (333)..(333): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaacgggccctcggtacttgactgaggctcaacagtgatggcagccacaggcgagggggaccgtactacccgngactcgtcttcgtcgacgtcgtccggctcgtgggactgagcgctacctcaccatctaccacgtccctaccgagtccgttaggacgggtaacggacggggttacgaacctttacgttacgtcggttacgaacgggtacggtacggggaaccgtaccgtgggaccttaagggtttcgggggttggttccgggggacgggtaacggggtacctaaaacgggttccggtaacccgttccggtaggtaccgtacggtaccccggaaacggtcccgtacccggtccccccgg

SEQ ID NO: 312958 - DNA, 593 bp, Homo sapiens
  misc_feature: GZ8MTXP02IOKP9.52.53.E09.1.454.CMB.2.raw
  modified_base (588)..(588): a, c, t, g, unknown or other
  misc_feature (588)..(588): n is a, c, g, or t
  modified_base (592)..(593): a, c, t, g, unknown or other
  misc_feature (592)..(593): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactcgtgaaggccattcacatctccagagacgagtccaggaacagcctgttctcaaatggacagtctgagacctgacgacacggctgtctaattactgtgcgagaacgaacccgagggggcggagaccacggacccccgtaaattcgtacggggccaacggggaaccccggtcgaaccgttctccctcgacgccctaccaaccgaaacgggcccagtccggtccttcccccgtcgccacccctcctacccgaaagcgacaccgttcgcgggggacacgagcccgggcccgtcgggccttcgccgtcggtaccgaaacggtactactttccgaattacgactcgactggaacgccggcgtcggacgaaggcgacanacgnn

SEQ ID NO: 312959 - DNA, 518 bp, Homo sapiens
  misc_feature: GZ8MTXP02IFG3O.52.53.E09.1.454.CMB.2.raw
tcagcgcagtacgacacgaccggtgctcgatttagagagagtgtgttgggtttgggggctgtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgccaaaagcaaatatgcttactggtaccagcagaacgccccggccacggcccctgtcttgctttattataaaagtctttgagaggccctcgacgggacccctgagcgacttctctggctcagctcacgcgacaacagtcacgttcgaacctatcaggtggacgtccgaggcaaggaggacgagctagaacttattacgtgtcagtcagtacagacagcagtgctacttagtgtctagttcggcggaacggaccaagtcgaccgtacgtacgtcacgaccgagtcccg

SEQ ID NO: 312960 - DNA, 581 bp, Homo sapiens
  misc_feature: GZ8MTXP02GWCEK.52.53.E09.1.454.CMB.2.raw
  modified_base (356)..(356): a, c, t, g, unknown or other
  misc_feature (356)..(356): n is a, c, g, or t
  modified_base (580)..(581): a, c, t, g, unknown or other
  misc_feature (580)..(581): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccattcaccatctccagagacgagtccaggaacagcctgtttctcaaatggacagtctgagacctgacgacacggctgtctattactgtgcgagacgaacccgagggggcggagcaccgccccgtatcgnggggccagggacccggtcaccgtctcctcacgcctaccaccgaacgggcccacgtccgtccttcccccgtgcccacccctcctaccgaacgcgccaccgtcgtacgggggcacgacggccggcccgtggggcctcggcccgtcggtaccgaaacggtaccttaccgttccgtaataccgacttccggctcggacggcgggctgggacgaacggcgacagtacgnn

SEQ ID NO: 312961 - DNA, 571 bp, Homo sapiens
  misc_feature: GZ8MTXP02I5SCU.52.53.E09.1.454.CMB.2.raw
  modified_base (145)..(145): a, c, t, g, unknown or other
  misc_feature (145)..(145): n is a, c, g, or t
  modified_base (206)..(206): a, c, t, g, unknown or other
  misc_feature (206)..(206): n is a, c, g, or t
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
  modified_base (359)..(359): a, c, t, g, unknown or other
  misc_feature (359)..(359): n is a, c, g, or t
  modified_base (570)..(571): a, c, t, g, unknown or other
  misc_feature (570)..(571): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccnccaggctccgaggggaaggggctggagtgggtctcaagttctttatggtcggtggtaccanatattatgctgactccgtgaaggccattcacatctcagagacgatccaggaacagccttgttctacaaatggacagtctgacgacctgaacgacacggtctgtctattctgtcgacgagacgaacccgngggggcgancacgccccgtatcgnggggccaggggacccgtcaccgtctcctcgacgccctaccaaccgaacgggcccagtcccggtcccttcccccgtggccctacccctcctaccaagacgccaccgtcgtcggggaccacgacgccggcccctgggcctcgccgtggtacaaggtactacgttccagtaccgactcgcgtgacggcggtcgcggacaacggcgactagacgnn

SEQ ID NO: 312962 - DNA, 641 bp, Homo sapiens
  misc_feature: GZ8MTXP02GA824.52.53.E09.1.454.CMB.2.raw
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaacgggccctcggtacttgatgaggctacaacagtgagtcggcacgccagaggcggacgggggacgtactcccgtgactccgacttcgtcgacggtcctccggctcgtgggactgacgcgctacctcaccactcctcacgcctccgacgtcgtcggaacggacggtaggggtacgacgttaacgttaccgtcgttacgacggtaacgggttacgggaaccgtaacggtcgggtaccgttaagggttttacgggggttcgggttaccgggggtaccggggtaacgggggtaaacccggtaacgggtttaccggtaaccccgggttaccgttaacgggttaccgaccggtaccccgaaacggggtcccgttaccccccgggg

SEQ ID NO: 312963 - DNA, 607 bp, Homo sapiens
  misc_feature: GZ8MTXP02HOW9A.52.53.E09.1.454.CMB.2.raw
  modified_base (289)..(289): a, c, t, g, unknown or other
  misc_feature (289)..(289): n is a, c, g, or t
  modified_base (374)..(374): a, c, t, g, unknown or other
  misc_feature (374)..(374): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgcatcgcatgcatcagctgcagccagagaacggccctcggtacttgatgagctacaacngtgagtggcagccacgaggcggacgggggacgtactcccgtagactcgtcttcgtcgacggccgtccggtctcggtcggtaccgngacgccgtactacctcacctactccaccacgccctcgtacgtcgtacggaacggtacggtaggtactaacgttacgttacgtcgtacgtacggtacggtacggacgtacgtcggtacgttagggtttcggggtacggttacggggacgggtaacgggtaaccgttaacggttaccggtaacccggttacggtaacggtaccgaaccggtacccggtaacggtcccgtccccgg

SEQ ID NO: 312964 - DNA, 564 bp, Homo sapiens
  misc_feature: GZ8MTXP02JZENI.52.53.E09.1.454.CMB.2.raw
  modified_base (307)..(307): a, c, t, g, unknown or other
  misc_feature (307)..(307): n is a, c, g, or t
  modified_base (339)..(339): a, c, t, g, unknown or other
  misc_feature (339)..(339): n is a, c, g, or t
  modified_base (386)..(386): a, c, t, g, unknown or other
  misc_feature (386)..(386): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctggtacttgatgaggctcaacagtgatggcagccagngcgagggggacgtactcccgtgatcgctttcncgaggcctccggctcgtaggggactgacgcgctacctcaccatcccncacgcctcagtcgaggacggacggtaggtagtacttatacgcgacgaggtacggtacggactacgtggtacgttaggtttggggtcggttcggggacgggtaacgggtaaccgtaacggttaccggtaacccggttaccgtacggtaccgaccggacccggtaacggtcccgtcccgg

SEQ ID NO: 312965 - DNA, 535 bp, Homo sapiens
  misc_feature: GZ8MTXP02JLP6V.52.53.E09.1.454.CMB.2.raw
  modified_base (534)..(535): a, c, t, g, unknown or other
  misc_feature (534)..(535): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccattcaccatctccagagacgagtccaggaacagcctgttcttcaaatggacagtctgagacctgacgacacggctgtctatactgtgcgagagaacccagggggcggagcacgccccgtaattctggggccagggacccgggtcaccgtctcctcagcctaccaccaagggcccatccggtccttccccctgcccaccctcctccaagacgcacctcgtgggggcacgacgcggcccgtgggcctcgccgtggtcaacggctacttcctatacgactcgctgacgcggcgtggcgaacgcgcgacann

SEQ ID NO: 312966 - DNA, 584 bp, Homo sapiens
  misc_feature: GZ8MTXP02FX9OG.52.53.E09.1.454.CMB.2.raw
  modified_base (260)..(260): a, c, t, g, unknown or other
  misc_feature (260)..(260): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (382)..(382): a, c, t, g, unknown or other
  misc_feature (382)..(382): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttatgtcggtggtaccacatattatgctgactcgtgaagggccattcaccatctccagagacgagtccaggaacngcctgttctcaaatggacagtctgacgacctgacgacacggctgtctatactgtgcgagacgaacccgnggggcggancacgccccgtatcgcggggccaggggacccggtcaccgtctccncagccctccaaccgacggcccacgtccgtccttcccccgtcggcccacccctcctaccaacgacgccaccgtcgtcgggggcacgacggccgggcccgtcgggcctcggccgtcgtacgaaacggtaccttaccgttacctagtaccgacttccggcgtacggacggccgggtcgcggacgaacgggcgacacgtacgngng

SEQ ID NO: 312967 - DNA, 545 bp, Homo sapiens
  misc_feature: GZ8MTXP02GIQ32.52.53.E09.1.454.CMB.2.raw
  modified_base (231)..(231): a, c, t, g, unknown or other
  misc_feature (231)..(231): n is a, c, g, or t
  modified_base (337)..(337): a, c, t, g, unknown or other
  misc_feature (337)..(337): n is a, c, g, or t
tcagcgcagtacgacacgaccggtgctcgatttagagagagtgtgttgggtttgggcacgaccggtgctcgatttagagagagtgtgttgggtttgggagcagagctctggggagtctgcaccatggcttggaccccactcctcttcctcaccctcctcctccactgcacagggtctctctcccagcctgtgctgactcaatcgccctctgcctctgcctcccgtgggacncctcggtcaagcctcacctgcactctgagcagtggcactacacctacgccatcgcatggcatcagctgcagccagagaggccctggtacttgatgaggctacaacngtgatggcagccagagcggagggggacgtactcccgtgactcgtacttcgtcacggcgtcccggctccgtggggactcggagccgactacctaccacctctcctcccagccctaccgacgttccgaggaacgggacggtaggggtacgtaccttaaagtaccgttgtccgaaggtaaccggtcgggacctacggttcggactttaggg

SEQ ID NO: 312968 - DNA, 616 bp, Homo sapiens
  misc_feature: GZ8MTXP02GEYYQ.52.53.E09.1.454.CMB.2.raw
  modified_base (183)..(183): a, c, t, g, unknown or other
  misc_feature (183)..(183): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggancctcggtcaagctcacctgcactctgagcagtggcactacacctacgccatcgcatggcatcagctgcagccagaggaacgggccctggtactgatggaggctacaacngtgatggcagccanaggacggagggggaccgtacgtcccgtgactcgtcttctcgacggcgtccggcttcgtggggactcggacgtcgcctaacctccaacctctcctcccaggtcccctccgacgttcgacgggaacgggacggtagggggttacaaccgtttagttaacccgtggtaccgaaggtaccgggtcggggaccaccgttggggtaccgtaggttttcgggggtggtttaccggggcgggtaacggggtaacccgtaaggttcggaacccgttcgttaagggaccacgggacccgaaggtccttcccgggcccccg

SEQ ID NO: 312969 - DNA, 600 bp, Homo sapiens
  misc_feature: GZ8MTXP02GOVJD.52.53.E09.1.454.CMB.2.raw
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (598)..(599): a, c, t, g, unknown or other
  misc_feature (598)..(599): n is a, c, g, or t
tcagcgcagtacgacacgaccggtgctcgatttagagagagtgtgttgggtttgggggagccttggtccagcctggtggttccctgagactctcctgtgcagcctctggattctccgtcagtagcaactacatgagctgggtccgccaggctccagggaaggggctggagtgggtctcaagtctttangtcggtggtaccacatattangctgactccgtgaagggccattcaccatctccagagacgagtccaggaacagcctgttctacaaatggacagtctgagacctgacgacacggctgtctattactgtgcgagacgacccgagggggcggagcaccgccccgtaagtcgcggggccacggggaacccggtcaccgtctccgcacgcctccaaccgaacgggccctacgtccgtcccttcccccgtgccctaccccgtcctacccgaagaccgccaccgtcgtacgggggcacgacggccgggcccgtgggcctcggccgtcggtaccgaaacgggtacctaccgttaccgtaacgtacgacgtccggactacggacggccgggacgcgggacgaaacggcgacgaagacgnng

SEQ ID NO: 312970 - DNA, 561 bp, Homo sapiens
  misc_feature: GZ8MTXP02FOGZT.52.53.E09.1.454.CMB.2.raw
  modified_base (204)..(204): a, c, t, g, unknown or other
  misc_feature (204)..(204): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (560)..(561): a, c, t, g, unknown or other
  misc_feature (560)..(561): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagtctttatgtcggtggtaccanatattatgctgactcgtgaaggccattcacatctccagagacgagtccaggaacagcctgttctcaaatggacagtctgagacctgacgacacggctgtctattactgtgcgagacgaacccgngggggcggagcacgccccgtatcgnggggccaggggaccggtcaccgtctcctcacgcctccaccaacgggcccagtccggtccttcccccgtgcccacccctcctacccaagacgccaccgtcgtgggggccacgacggccggcccgtcggggctcggccgtggtacaaggtacctacttaccctataccgactccgctcgacggcgggcgtggacaacggcgacaatcgnn

SEQ ID NO: 312971 - DNA, 604 bp, Homo sapiens
  misc_feature: GZ8MTXP02HGIGS.52.53.E09.1.454.CMB.2.raw
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggtttcctgttgctatttaaaggtgtccagtgtggagtgcaggtggtggagtcgtgggggagcttggtccagcctggtggttccctgacgactctcctgtgcagccctnggattcncccggtnagtanacaactanangacgcgtcggtccgcgaggcctacggaaggggagggcgtagggacgtggtctacgtaagttcctttagtggtcggtagtaccatattatagtgctagacgtcggagaacggctatcactatcacgagacgacgacgtaccaagactacgtccgtttagttacttaacgaaagtcggaaactagtcgtagaccgacgtacgaaaccgacgtacggtcttacggttacttacgttacggtcgtacggacgaacggaaccgggaacgggcgggggacgtaacgaccgaccggttacccggttaaggttcccgg

SEQ ID NO: 312972 - DNA, 598 bp, Homo sapiens
  misc_feature: GZ8MTXP02JVGP7.52.53.E09.1.454.CMB.2.raw
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (275)..(275): a, c, t, g, unknown or other
  misc_feature (275)..(275): n is a, c, g, or t
  modified_base (336)..(336): a, c, t, g, unknown or other
  misc_feature (336)..(336): n is a, c, g, or t
  modified_base (576)..(576): a, c, t, g, unknown or other
  misc_feature (576)..(576): n is a, c, g, or t
  modified_base (596)..(597): a, c, t, g, unknown or other
  misc_feature (596)..(597): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgagggaagggctggagtgggtctcaagtctttangtcggtgtaccanatatangctgactcgtgaggccattcaccatctcagagacgngtccaggaacngtccttgttctacaaatggacngtctgacgacctgacgacacggtctgtctaattacgtggtgacgaagaaccggaacccggngggggacgacgaccgaacccgtcccccgttaattcggcggggacccgaacggggaacccggttccacccgtctcccgtacgacgccctaccgaaccgacggtccctacgttcccggtacccttccccgcgaccctaccccgtctaccgaagacgcctaccgtcggtcgggcacgcgccggcgtggctcgcgtggacacgtactacgtacgtacgacgactcgacgtcggacgcggtacgnggacgacggcacgacgtcgnng

SEQ ID NO: 312973 - DNA, 620 bp, Homo sapiens
  misc_feature: GZ8MTXP02I21F7.52.53.E09.1.454.CMB.2.raw
  modified_base (206)..(206): a, c, t, g, unknown or other
  misc_feature (206)..(206): n is a, c, g, or t
  modified_base (261)..(261): a, c, t, g, unknown or other
  misc_feature (261)..(261): n is a, c, g, or t
  modified_base (405)..(405): a, c, t, g, unknown or other
  misc_feature (405)..(405): n is a, c, g, or t
  modified_base (618)..(619): a, c, t, g, unknown or other
  misc_feature (618)..(619): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagttctttatggtcggtggtaccanatattatgctgactcgtgaaggccattcacatctccagagacgagtccaggaacngtccttgttctacaaatggacagtctgacgacctgaacgacgacggtctgtctattacgtgtgacgagaacgaacccggagggggcggagcaccggccccgtaattcggacggggaccaacggggacccggtcaccgtctaccncgacgccctaccgaaccgaaccgggcccacgttccgtccccttcccccgtcggaccctaccccctcctacccgaacgacgacccaccgtcggtcgggggaccacgacggcccggccgtcgggcctcggccgtcggtaccgaaacggtccttaaccttaccgtacgtaccgatccgacgtcggacggcggacgcggcgaacgggcacgagtcgnng

SEQ ID NO: 312974 - DNA, 576 bp, Homo sapiens
  misc_feature: GZ8MTXP02IEAP8.52.53.E09.1.454.CMB.2.raw
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (575)..(576): a, c, t, g, unknown or other
  misc_feature (575)..(576): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctgggagtgggtctcaagttctttatggtcggtggtaccanatattangctgactcgngaaggccattcaccatcnccagagacgatccaaggaacagccttgtttctacaaatggacagtctgacgacctgacgacacggtctgtctattactgtgcgagacgaacccgagggggcggagcgaccgacccccgtaatcgtggggccgacggggacccggtcaccgtctcctcacgcctaccaccgaacggcccagtccggtccttcccccgacgcccaccctccctaccgaacgacgccaccgtcgtcgggggcacgacggccggcccgtggggcctcggccgtgggacacggtacctacgttcctagtaccgatcgctcggacgtcggctggcaacggcgacatagnn

SEQ ID NO: 312975 - DNA, 509 bp, Homo sapiens
  misc_feature: GZ8MTXP02FFWVW.52.53.E09.1.454.CMB.2.raw
  modified_base (325)..(325): a, c, t, g, unknown or other
  misc_feature (325)..(325): n is a, c, g, or t
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (447)..(447): a, c, t, g, unknown or other
  misc_feature (447)..(447): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctggtactgatgaggctcaacagtgatggcagcacagcgagggggaccgtatcccgngatcgcttctcgaggctcggctcgtgggactggagcgctaccgtcacatcnccagcctcagtcaggaggacgngggtnacttattactgtcaggacgtgggacacgtggactagtttggggngttcggcggacgggaccgtaagttcggaaccgtccgaggtcacgcccaaggcctcgcccccg

SEQ ID NO: 312976 - DNA, 584 bp, Homo sapiens
  misc_feature: GZ8MTXP02IWWPB.52.53.E09.1.454.CMB.2.raw
  modified_base (314)..(314): a, c, t, g, unknown or other
  misc_feature (314)..(314): n is a, c, g, or t
  modified_base (331)..(331): a, c, t, g, unknown or other
  misc_feature (331)..(331): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (583)..(583): a, c, t, g, unknown or other
  misc_feature (583)..(583): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccattcaccatctccagagacgagtccaggaacagccttgttctcaaatggacagtctgacgacctgacgacacggctgtctattacngtgcgagacgaacccgnggggcggancacgccccgtatcgnggggccagggaacccggtcaccgtcnccncacgcctaccacgaacgggcccagtccggtaccttcccccgtcggacccaccccctcctacccgaaacgacgccaccctcggtcgggggccacgacgcggcccgtgggctcgcccgtggtaccgaaacggtacctaacttacccttactacggactccgactcgacggccgggcgtggccgaaggcgacgactacggcng

SEQ ID NO: 312977 - DNA, 654 bp, Homo sapiens
  misc_feature: GZ8MTXP02JVPMM.52.53.E09.1.454.CMB.2.raw
  modified_base (328)..(328): a, c, t, g, unknown or other
  misc_feature (328)..(328): n is a, c, g, or t
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagctgcagccagagaacggcctcggtactgatgaggctacaacagtgagtggcagccagaggcggagggggaccgtactccgngactcgcttctcgaggctccggctcgtgggactcggacgtcgtacctacccgtcaaccctatcccgtaccacggtccctaccgacggttcctaggggacgggtaaccggtagggggtactaacgtttaacgtttaaccgtggtaccgtaaaggggtacgggttacggggaacctaacgggttcgggacgtttaagggttttcgggggtcgggtttaccgggggacggggtaacggggtaccgttaaacggggttccggaacccggttaaccggtacggttacccgaacggaccccggaaacggttcccgtacccggttccccccgg

SEQ ID NO: 312978 - DNA, 546 bp, Homo sapiens
  misc_feature: GZ8MTXP02FJ6G4.52.53.E09.1.454.CMB.2.raw
  modified_base (145)..(145): a, c, t, g, unknown or other
  misc_feature (145)..(145): n is a, c, g, or t
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
  modified_base (303)..(303): a, c, t, g, unknown or other
  misc_feature (303)..(303): n is a, c, g, or t
  modified_base (318)..(318): a, c, t, g, unknown or other
  misc_feature (318)..(318): n is a, c, g, or t
  modified_base (544)..(545): a, c, t, g, unknown or other
  misc_feature (544)..(545): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccnccaggctccaggaaggggctggagtggtctcaagtctttantcggtgtaccanatattangctgactcgtgaaggccattcacatctcaganacgagtccaggaacagctgttctcaaatggacagtctgagacctgacgacacggctgtctattacngtgcgagagacccgnggggcgagcacgccccgtaatcgtggggccaggaccggtcaccgtctcgtcagctaccgacaacggcccactccggtcctccctgccaccctccaccagacgcaccgtcgtggggcacgcgccggccgtcggctcgaccttcggacaacggtactaccttaccttaacacggtaacttcggaccgtacggacggcggacgaacggacgaacggccgacgactacgnng

SEQ ID NO: 312979 - DNA, 598 bp, Homo sapiens
  misc_feature: GZ8MTXP02HNHUG.52.53.E09.1.454.CMB.2.raw
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
  modified_base (402)..(402): a, c, t, g, unknown or other
  misc_feature (402)..(402): n is a, c, g, or t
  modified_base (438)..(438): a, c, t, g, unknown or other
  misc_feature (438)..(438): n is a, c, g, or t
  modified_base (597)..(597): a, c, t, g, unknown or other
  misc_feature (597)..(597): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagtctttatggtcggtggtaccacattattatgctgactccgtgaagggccattcaccatcncagagacgagtccaggaacngccttgttctacaaatggacagtctgacgacctgacgacacggctgtctattactgtgcgagacgaacccgaggggcggagcaccgccccgtaatcgaggggccaacggggacccggtcaccgtctccgtcgacgcccnccaccgaacgggccctacgtcccgtccttcccccgngccctaccctcctaccgaacgacacctacccgtcggtcgggggaccacgcggccggcccgtggggcctcgccgttggaccaaacgggtcctactttaccgaacgttaccgactcgttcgaggacggccgggcgtcggacgaacgggccacgagtcgcgng

SEQ ID NO: 312980 - DNA, 607 bp, Homo sapiens
  misc_feature: GZ8MTXP02JAO3C.52.53.E09.1.454.CMB.2.raw
  modified_base (505)..(505): a, c, t, g, unknown or other
  misc_feature (505)..(505): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacactacgcatcgcatggcatcagctgcagccagagaacggcccgtcggtacttgatgaggctacaacagtgatggcacgccgaacgaggacggaggggggtaccgtacgtcccgtagtactcgtcttcgtcgacggtccgtcccggtcgtacgtcggggacttcgacgccgtaccctacctacaccctactccctaccgacgtccctcgagttccgtaggacgggacggtaggggtactacgttaacgttaccgtagttaccgaaggtacggtcgggtaacncgtacggtctggtttggggtcggttcgggacgggtacgggtaaccgtaggtttccggaaccggttacgtacggtacgacgtacccgtaacggcctaccccgg

SEQ ID NO: 312981 - DNA, 549 bp, Homo sapiens
  misc_feature: GZ8MTXP02FI6OV.52.53.E09.1.454.CMB.2.raw
  modified_base (374)..(374): a, c, t, g, unknown or other
  misc_feature (374)..(374): n is a, c, g, or t
  modified_base (528)..(528): a, c, t, g, unknown or other
  misc_feature (528)..(528): n is a, c, g, or t
  modified_base (548)..(549): a, c, t, g, unknown or other
  misc_feature (548)..(549): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccattcaccatctccagagacgagtccaggaacagcctgttcttcaaatggacagtctgagacctgacgacacggctgtctattactgtgcgagagaacccgagggggcggagcacgccccgtaatcgtggggccaggggacccggtnaccgtctcctcagcctccaccaacgggcccatcggtccttccccctggccacccctcctaccgaagacgccacctcgtgggggcacgacgccgggccctggggctcgccctgggtacaaggtactactcctatacacgtcgctgacgcggggcnggacgacggcgacgacgagnn

SEQ ID NO: 312982 - DNA, 551 bp, Homo sapiens
  misc_feature: GZ8MTXP02IP18B.52.53.E09.1.454.CMB.2.raw
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctccagcctgtgctgactcaatcgccctctgcctctgcctccctgggagcctcggtcaagctcacctgcactctgagcgagtggcactacgacctacgcatcgcatggcatcagctcgcagccagagaaggccgtacggtaccgttgagtgaggctacaacagtgaagtggcgacgaccgacgaggacggacggggacggtacgtccgtcgtactcgtcgttcgtcgacggtccgtccgcgtcgtcggtacgtgacgcgctactcaccactctcccncncctcacgtcgagacgagtagtagtactactacgtacgtacgacgacgtagacgtacgtcgtcgtagttggtcggtcggtacggtacggtacgtacgtacgtaacgtacgtacggtacgacgaccgtacgtacgtccg

SEQ ID NO: 312983 - DNA, 618 bp, Homo sapiens
  misc_feature: GZ8MTXP02H7M78.52.53.E09.1.454.CMB.2.raw
  modified_base (288)..(288): a, c, t, g, unknown or other
  misc_feature (288)..(288): n is a, c, g, or t
tcagcgcagtacgacacgaccggtgctcgatttagagagagtgtgttgggtttgggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacactacgccatcgcatggcatcagctgcagccagacgacggcctggtacttgatgaggctacgaacngtcgagtggacaggccaacgacggacggaacggggggaccgtacgtccccgtaggactcggtccttcgtcgacgggtctccgggctacgtcggggactgacgcgctacctcacactccgtacacgtccctccgtagtcgtaggacggtacgagggggttacaacgttagttaaccgttgacgacggtacgggtacgggactacggtcggtacgttaaggtttcgggggttgttacgggacgggtacgggtaacccgtaaggttccggaaacccggttccgttaacgggtaccgaacggtacccgaacgggtccgttacccggtcccccgg

SEQ ID NO: 312984 - DNA, 621 bp, Homo sapiens
  misc_feature: GZ8MTXP02H87TX.52.53.E09.1.454.CMB.2.raw
  modified_base (412)..(412): a, c, t, g, unknown or other
  misc_feature (412)..(412): n is a, c, g, or t
  modified_base (547)..(547): a, c, t, g, unknown or other
  misc_feature (547)..(547): n is a, c, g, or t
  modified_base (560)..(560): a, c, t, g, unknown or other
  misc_feature (560)..(560): n is a, c, g, or t
  modified_base (587)..(587): a, c, t, g, unknown or other
  misc_feature (587)..(587): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggtttttccttgttgcttaattttaaaaggtgtccagtgtggagtgcgaggtggtggagtcgtgggggagcgttggtccagccgtgggtggttccctgagactctcctgtgcacgtcctcgtggacttcctccgtacagtacgcaaactacagtgagtcgtcgggtcccgccgaggcctaccggaaggggaaggggctggggagtcggggtactacgaagttccttagtcggtcgtaggtaccagtattattagtnccgtgaccgtccgggtagaaaccgggccctatcccacctactccaccgaaggacgacgacgtacccgaaggaacacgtcctttagtttcttaacaaagtcggactagtctagacgcgtagaccgtacgacggtcngttctaatttcgngcgaccgaggaaccggaacccgggggnggggacgacgtaccgaccggtacccgtacgcggg

SEQ ID NO: 312985 - DNA, 533 bp, Homo sapiens
  misc_feature: GZ8MTXP02F381B.52.53.E09.1.454.CMB.2.raw
  modified_base (306)..(306): a, c, t, g, unknown or other
  misc_feature (306)..(306): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (500)..(500): a, c, t, g, unknown or other
  misc_feature (500)..(500): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttccttgttgctatttaaaaggtgtccagtgtggagtgcaggtggtggagtcgtgggggaggcttggtccagcctggtggttccctgagactctcctgtgcagcctctggattctccgtcagtagcaactacatgagctgggtccncaggctccgaggggaaggggctgggagtgggtctacgaagtcctttatgtcggtggtaccanatnttangctgactcgtggaaggccgattccacatctccagagacgagtccagacagtcctgttctacaaatggacagtctgacgacctgacgacgacgctgtctattactggcgtacgagacgaacccggngggggacggacgcgtacgccccgtaattccggg

SEQ ID NO: 312986 - DNA, 583 bp, Homo sapiens
  misc_feature: GZ8MTXP02JAHCW.52.53.E09.1.454.CMB.2.raw
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (517)..(517): a, c, t, g, unknown or other
  misc_feature (517)..(517): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagcttgggttttccttgttgcttattttaaaaggtgtccagtgtggagtgcaggtggtggagtcgtgggggagcttggtccaggcctggtcggttccctgagactctcctgtgcagcctcgtggattcctccgtcagtagccaaactacatgagcgtgggtcccncaggctccggaggggacgggntggagtggtcntaagtcctttagngtcgtgtacactatnttangtctgactcggtaggaacgggtcctaattccactatcctccaagacgacgacgtaccaaggaactacgtccttgtttactacaaagtcggaacagtctagacgacctagacgacgacggtctcgttattacttacgngacgtacgaaggaacgaacccgggagggggacgacgaccgaccggtaccccgtaagtttcccgggg

SEQ ID NO: 312987 - DNA, 602 bp, Homo sapiens
  misc_feature: GZ8MTXP02HPDIS.52.53.E09.1.454.CMB.2.raw
tcagcgcagtacgacacgaccggtgctcgatttagagagagtgtgttgggtttgggagagctctggggagtctgcaccatggcttggaccccactcctcttcctcaccctcctcctccactgcacagggtctctctccagcctgtgctgactcaatcgccctctgcctctgccctcccgtgggagcctcggtcaagctcacctgcactctgagcagtggcactacacctacgccatcgcatggcatcagctgcagccagaggaacggcctcggtactgatgaggctacaacgagtgagtaggcaggccagacggcgggacgggggacgtactcccgtggatccgcttctcgacgtccgtcccggcttacgtgggactggacgcccgactaccctacaccctaattcccaccacgcctccacgtcgtacggacggacgggtaacgggtagtacgttaacgttacgtacgttacggtacggacggttacgggacgtaacgtacggtacgttacggtttaggggttcgggtttcggggacgggtacgggaaccggtaacggtacgtaaccggtacgtacggtacgacgaccgaccgacgtcccgg

SEQ ID NO: 312988 - DNA, 556 bp, Homo sapiens
  misc_feature: GZ8MTXP02JDVNY.52.53.E09.1.454.CMB.2.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
  modified_base (440)..(440): a, c, t, g, unknown or other
  misc_feature (440)..(440): n is a, c, g, or t
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
  modified_base (555)..(556): a, c, t, g, unknown or other
  misc_feature (555)..(556): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccanatattatgctgactccgtgaagggccattcaccatctccagagacgagtccaggaacagcctgttctcaaatggacagtctgagacctgacgacacggctgtctattacngtgcgagacgaacccgngggggcgagcacgccccgtatcgnggggccaggggaacccggtcaccgtctcctcacgcctaccaccgaaacgggcccagtccggtccttcccccgtcgcccacccctccnccaagacgcacctcgtgggggcacgacgccggccgtcgggctgccgtggtacaacggtactacgttccgtataccgacttcgctcgacgtcgggctggcaacggccganacgngnn

SEQ ID NO: 312989 - DNA, 483 bp, Homo sapiens
  misc_feature: GZ8MTXP02JGC5I.52.53.E09.1.454.CMB.2.raw
  modified_base (286)..(286): a, c, t, g, unknown or other
  misc_feature (286)..(286): n is a, c, g, or t
  modified_base (341)..(341): a, c, t, g, unknown or other
  misc_feature (341)..(341): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
tcagcgcagtacgacacgaccggtgctcgatttagagagagtgtgttgggtttgggaaagctctggggagtctgcaccatggcttggaccccactcctcttcctcaccctcctcctccactgcacagggtctctctcccagcctgtgctgactcaatcgccctctgcctctgcctccctgggacgcctcggtcaagctcacctgcactctgagcgagtgggcaacgtacactacgccatcgcatggcatcagctgcagccagagacggcctggtactgatgagctnacagtgatggcagccacgaggccgaggggggaccgtatccccgtgactcgcttcncgagctcggctcgtgggactgagcgctaccncacntcncncncncngcgngngagngtgatatangcgagngngagngngngtgtggtggtcggcggacggacgtacgtacgcgtcgtacgacgacgacgacgcgtccgccg

SEQ ID NO: 312990 - DNA, 797 bp, Homo sapiens
  misc_feature: GZ8MTXP02F76CE.52.53.E09.1.454.CMB.2.raw
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttccttgttgctatttaaaagtgtccagtgtggagtgcaggtggtggagtcgtgggggaggcttggtccagcctggtggttccctgagctctcctgtgcagcctctggattctcgtcagtagacaactacatgagcgtcgggtcccgccgaggcctaccggaagggggaacggggtcgtggggtaggttcggggtactaccgtaaaggttcccttttaagtcgggttccgggttacgggttaaccctaacgtaatttacgttaagtcggtccgttacgtacccgtttacccggtagggaaaacccgggggtccctaatttaccccgaaccctaagttccctacccgaaaggaaccggtaaaccgaacggttacccccgaaaaggaaacccgtaacggttccccctttaggtttttaccctttaaaccgaaaaagtttcgggggaaaaccctggttaccgttaaggaacgtaaccccgttaggaaacccgtaaaccgccgggtaacttcgggttaccctttaaagtttaccgtggtcggaaaccggaacggaaacgggaaacccccggggaaggggggggttccccggaaaggtacccggaaacccggttaccccccggtttaaagtttccccggggg

SEQ ID NO: 312991 - DNA, 645 bp, Homo sapiens
  misc_feature: GZ8MTXP02JPWQI.52.53.E09.1.454.CMB.2.raw
  modified_base (202)..(202): a, c, t, g, unknown or other
  misc_feature (202)..(202): n is a, c, g, or t
  modified_base (515)..(515): a, c, t, g, unknown or other
  misc_feature (515)..(515): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccanatattatgctgactcgtgaaggccattcacatctccagagacgagtccaggaacagccttgtttctacaaatggacagtctgacgacctgacgacacggctgtctattactgtgcgagacgaacccggagggggcggagcacccggtcccccgtaagtcgcggggaccaacggggaaccccggtcacccgtctcccgtacacgcccaccgaacccgacgggccctacgttcccggtcccttccccgtcgccctaccccgtcctacccaaagcgcctaccgtcggtacgggggccaacgtcggccgggtcccgnggggctacggcccgtgggtaccgaaacggtaccttacctttcccgtaacgtaccggtacttccggcgttacggggacggttcccgggggcttaacgggggacccaaagggggccctacgaacgtcgngng

SEQ ID NO: 312992 - DNA, 588 bp, Homo sapiens
  misc_feature: GZ8MTXP02F6V6Z.52.53.E09.1.454.CMB.2.raw
  modified_base (194)..(194): a, c, t, g, unknown or other
  misc_feature (194)..(194): n is a, c, g, or t
tcagcgcagtacgacacgaccggtgctcgatttagagagagtgtgttgggtttgggggctgtgggtccaggaggcagaactctgggtgtctcaccatggcctggatccctctacttctccccctcctcactctctgcacaggctctgaggcctcctatgagctgacacagcccaccctcggtgtctgtgtcctnaggacagacggccaggatcacctgctctggagatgctattcgaccaaagcaatatgcttactgtaccagcagaacgcccgccacggccctgtctgtactttatttaataaagtacgtttgacgtacggtccctacgacggaccctgacgtcgtacttcctcgtcggtcctaccgacgtctcgacgaccgaaaccaacgtacgtacgtacgttacgaacctacgtacgagtcggacgtccgaggcgaaggacggaccgaggtctaggtaacttaagttacgtgtacgtacgttacacgtacgacgacgagcgaggtgacttacttagtgttacgtaggttcggacggaacggaacctaacgtccgaccgtacgtacgacaccgaccgacgtcccg

SEQ ID NO: 312993 - DNA, 689 bp, Homo sapiens
  misc_feature: GZ8MTXP02IJTS3.52.53.E09.1.454.CMB.2.raw
  modified_base (361)..(361): a, c, t, g, unknown or other
  misc_feature (361)..(361): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgccctcccgtgggacgcctcggtcaagctcacctgcactctgagcaggtggacactacacctacgccatcgcagtggcatcagctgacacgccaagacggaacgggccctacggtacttgagtggacggctacgaaacgagtagagtgggacacgccaacgaggacgggaagggggtaccgtacgtccgngtacgtcgtcttctcgagtccgtccggcgtcgtgggactggacgtcgacctacctcaaccactccctaccgacgtcccgtaccgacgtcgtagggaacgggtacgggtacgggttactaacgttacgttaacgtcggtacgtaacggtaacgggtcggtaaccgtacggtacggtaacgtttagggtttcgggggtttaccgggttaccggggaccgggggtaaacgggtaacccggttaaaacgggtttccggtaaacccggttaacggttaacgggacccgtaaccggacccggtaaccggtcccggttaacccggttccccccgg

SEQ ID NO: 312994 - DNA, 706 bp, Homo sapiens
  misc_feature: GZ8MTXP02GSVK7.52.53.E09.1.454.CMB.2.raw
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagcttgggttttccttgttgcttatttaaaaggtgtccagtgtggagtgcaggtggtggagtcgtgggggagcttggtccagcctggtggttccctgagactctcctgtgcagcctctggattctccgtcagtagcaaactacatgagcgtgggtccgccaggcctccgaggggaaggggctgggagtggggtctacgtaagttcctttatggtcgggtaggtaacccactaagttatttagtgtccttagaccttcccggtagggaaaccgggggccctaactttacccaacccacttccctacccgaaaggaacggtaacccgaacggtaccccgaaaagggaaaccctaacgggtccctttaggtttttaccgttaacaaaaagttcggggaaaactacggttaccgttaggaaccgtaccctaggaaacccgtaaccgacggggtacttcggtacctttaatttaaccggtggtacgaacggaacggaaaccggaacccggggagggggaccggacggaccgtaacccggtaccccggttaacgttccggg

SEQ ID NO: 312995 - DNA, 632 bp, Homo sapiens
  misc_feature: GZ8MTXP02H23DJ.52.53.E09.1.454.CMB.2.raw
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
  modified_base (356)..(356): a, c, t, g, unknown or other
  misc_feature (356)..(356): n is a, c, g, or t
  modified_base (399)..(399): a, c, t, g, unknown or other
  misc_feature (399)..(399): n is a, c, g, or t
  modified_base (459)..(459): a, c, t, g, unknown or other
  misc_feature (459)..(459): n is a, c, g, or t
  modified_base (631)..(631): a, c, t, g, unknown or other
  misc_feature (631)..(631): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctgggagtgggtctcaagtctttatggtcggtggtaccanattattatgctgactccgtgaaggccattcacatcncagagacgagtccaggaacagccttgtttctacaaagtggacagtctagacgacctgaccgacacggtctgtccttaagttactggtgacgagacgaaccccgagggggcggancgaccgccccgtaattcgacggggccaaggggaacccccggtnaccgttctcccgtcgacgccctacgaaaccgaacgggcccacgtccggtccttcccccgngcccacccctcctaccaagcgccaccgtcggtacggggacacgacggccgggccgtcgggcctcggtcccgtggtaaccgaacggtaccttaccgttacctaacgttaccgtaacgttccggcgtacgggacggccgggcgtaacgggaccgaacggcgaccgaagtacgcng

SEQ ID NO: 312996 - DNA, 660 bp, Homo sapiens
  misc_feature: GZ8MTXP02GOHYA.52.53.E09.1.454.CMB.2.raw
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggacgcctcggtcaagctcacctgcactctgagcagtggcactacacctacgccatcgcatggcatcagctgcagccagagaacggccctggtacttgatggacggctacaacgagtgaagtcggacagccacgaggacggaagggggtacccgtactcccgtagtactcgtccgttctcggacgggtccgtccggtccgttccggtcggggaccttggacgccgtaccctacccgtacaccctactcctaccacgtcccttaccgacgtcgtaggaacggaacggtaggggtactacttaacgttacgtcggtacgaacggtacggttacggaccgtaacgttgggaccgtttaagggtttccgggggttggttaccgggggacggggtaacggggtaacccgttaaacggttccggaacccggttaacgtaacgggtaccgacggtacccgaacggtcccgttacccggtccccccgg

SEQ ID NO: 312997 - DNA, 543 bp, Homo sapiens
  misc_feature: GZ8MTXP02GE5E9.52.53.E09.1.454.CMB.2.raw
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
  modified_base (267)..(267): a, c, t, g, unknown or other
  misc_feature (267)..(267): n is a, c, g, or t
  modified_base (332)..(332): a, c, t, g, unknown or other
  misc_feature (332)..(332): n is a, c, g, or t
  modified_base (387)..(388): a, c, t, g, unknown or other
  misc_feature (387)..(388): n is a, c, g, or t
  modified_base (423)..(423): a, c, t, g, unknown or other
  misc_feature (423)..(423): n is a, c, g, or t
  modified_base (522)..(522): a, c, t, g, unknown or other
  misc_feature (522)..(522): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
  modified_base (542)..(543): a, c, t, g, unknown or other
  misc_feature (542)..(543): n is a, c, g, or t
tcagcgcagtacgacacgaccggtgctcgatttagagagagtgtgtgggtttgggggaggcttggtccagcctggtggttccctgagactctcctgtgcagcctctggattctccgtcagtagcaactacatgagctgggtccgccaggctccaggggaaggggctggagtgggtctcaagtctttangtcggtgtaccanatattangctgactcgngaaggccattcacatctcagagacgagtccaggaacagccttgttctanaaatggacagtctgacgacctgacgacacggctgtacttattacgtgtgacgaagacgaaccggnggggcgagcaccgccccttaatcgcggggaccacggggacccgtcaccgtctccnncgccctacacgacggcctagtccgtccttccccgngcccaccctcctacaagacgcaccgtcggtcgggcacgcgccggccgtggctcgcgtcgacgaacgtactacttccgagtcgactcgactcgacgcggngcgacgacggcncgacgngnn

SEQ ID NO: 312998 - DNA, 596 bp, Homo sapiens
  misc_feature: GZ8MTXP02FJZMU.52.53.E09.1.454.CMB.2.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (390)..(390): a, c, t, g, unknown or other
  misc_feature (390)..(390): n is a, c, g, or t
  modified_base (594)..(595): a, c, t, g, unknown or other
  misc_feature (594)..(595): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttangtcggtggtaccanatattatgctgactccgtgaacgggccattcaccatctccagagacgagtccaggaacagcctgtttctcaaatggacagtctgacgcctgacgacacggctgtctattacngtgcgagacgaacccgngggggcggancaccgccccgtatcgtggggccacggggaacccggtcacccgtctccncacgccctaccgaccgaacgggcccacgtccggtccttcccccgtgcccacccctcctacccgaacgacgccacccgtcggtacgggggccaacgcggccgggcccgtcggggcctcggccgtcggtaccaacgggtacctacttaccctagtaccgactccggctcggacggtcgggcgtcgggacgaacggccgagacgcgnng

SEQ ID NO: 312999 - DNA, 661 bp, Homo sapiens
  misc_feature: GZ8MTXP02GVMPO.52.53.E09.1.454.CMB.2.raw
  modified_base (186)..(186): a, c, t, g, unknown or other
  misc_feature (186)..(186): n is a, c, g, or t
  modified_base (397)..(397): a, c, t, g, unknown or other
  misc_feature (397)..(397): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgccctccctgggancctcggtcaagctcacctgcactctgagcagtgggcactacacctacgccatcgcatggcatcagctgcagccagagaacggcctcggtactgagtgaggctacaactagtgatggacacgaccacgaggacggaacggggggtacgtactcccgtgacgtcgtctcgtcacggtccgtccggctcgtcgggactgcgccgtactaacccncaacccatccctacacgcccttaccgcgtaccgtggaacggtaccggtaggggttactaacgttacgtttaacgtcggttaccgaggtaacccgggttggaaaacccgtaggttacggggtccttaaacgggggtttttgggggtccgggtttacgggggaccggggtaaacgggggtaaccccggtaaaaggtttccgggaacccgtttaccggttaaacggggtccgtaaaccggcccgtaaacgggtcgttacccccgggg

SEQ ID NO: 313000 - DNA, 591 bp, Homo sapiens
  misc_feature: GZ8MTXP02I9YOY.52.53.E09.1.454.CMB.2.raw
  modified_base (417)..(417): a, c, t, g, unknown or other
  misc_feature (417)..(417): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgccctccctgggacgcctcggtcaagctcacctgcactctgagcagtgggcactacacctacgccatcgcatggcatcagctgcagccaagacgaacgggccctacggtacttgatggacggctacaacagtgatggcacgaccacgaggtcggaacggggggtaccgtactcccgtagacgtccggctttccgcgaggtccgtccggctcggtagggacctggagccgtctaccgtcaaccgtntccctccaacgccttaccgacgtcgtacggaggaccggtagggtcgtaacttagttaccgtgttacaggtacggtggactacgtgggactagggtttgggtcggttacggggacggtacgggaccgtaacggtcgaaccgttcgtaacggcgaccggtacccaggtctccccgg

SEQ ID NO: 313001 - DNA, 632 bp, Homo sapiens
  misc_feature: GZ8MTXP02I2QP7.52.53.E09.1.454.CMB.2.raw
  modified_base (294)..(294): a, c, t, g, unknown or other
  misc_feature (294)..(294): n is a, c, g, or t
  modified_base (586)..(586): a, c, t, g, unknown or other
  misc_feature (586)..(586): n is a, c, g, or t
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgcacagggtctctctcccagcctgtgctgactcaatccgcctctgcctctcgccctcccgtgggacgtcctcggtacaagcctcaccgtgccactctgagcagtggcactacacctacgccatcganagtggcatcagcgtgcacgccaaggacgaaccgggtccctacggtacttacgagtggacgaccttacgaaacgtagtggacgtcggacaaccgccgaacgacggggacggggtaaacggggggtacgttaacgtcccgtagtaccgtcgttccgtttccgcgtacggccgtcccggcgtcgggtcgggtacgtcgggtacgcccggtacctaccctaccgaacctactcccacgccgtacctccgtaacgtccgtagggtacgggacgtagggtacgttacgtacgttacgnggttaacgcggtacggtacggacgtacggttggtacgttttcgggg

SEQ ID NO: 313002 - DNA, 645 bp, Homo sapiens
  misc_feature: GZ8MTXP02HSWWD.52.53.E09.1.454.CMB.2.raw
  modified_base (361)..(361): a, c, t, g, unknown or other
  misc_feature (361)..(361): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgcctctgcctctgcctcccgtgggagcctcggtcaagctcacctgcactctgagcaggtggcactacacctacgccatcgcagtggcatcagctgcagccagagaacggccctggtacttgatggacggctacgaaactagtcggatgggacagccaacgaggacggaacgggggacccgtactcccgtagactcgtacttcncgacggctccggcgtcgtcgggactggacgccgtacctacctcacctactcctaccgtacgccctcgacgttcgtagggaaacgggtaccggtaagggttacgtacgtttaaacgttcgtacgtacgaacggtacgggttacgggaactaccggtagggtccgttaagggttttcgggggttccggtacggggtacggggtaaaccgggtaaccgtaacggtttacggacccgttcggtaacggtaccgacggacccgtaacgggtccgttacccggtcccccg

SEQ ID NO: 313003 - DNA, 620 bp, Homo sapiens
  misc_feature: GZ8MTXP02I7APV.52.53.E09.1.454.CMB.2.raw
  modified_base (293)..(293): a, c, t, g, unknown or other
  misc_feature (293)..(293): n is a, c, g, or t
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgcacaggtctctctcccagcctgtgctgactcaatccgcctctgcctctcgccctcccgtgggacgccgtcggtacaacgcctccacctgcactctgagcagtggcactacacctacgccatcganatgcatcagctgcagccgagacggaacggcctacggtactgagtcggacggtcctacgaaacgagttggaagtcgggaccaacgcccgaaacgacgggacggggaacggggggtaccgtacgtcccgtagtacgtcgtccgttcgacgtcggtcccgtccggtcgttcggtacgggtacgtacggaccggccgtaccctaccctaccgaaccgttactcccgtaccaccgtcccgtacgtacgttcgacggacggacggtagggtactaccgttacgtaccgtagaacgtacggacggttacgggacctaggtcggtacgtttaggg

SEQ ID NO: 313004 - DNA, 621 bp, Homo sapiens
  misc_feature: GZ8MTXP02IN5NR.52.53.E09.1.454.CMB.2.raw
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
  modified_base (612)..(612): a, c, t, g, unknown or other
  misc_feature (612)..(612): n is a, c, g, or t
  modified_base (619)..(620): a, c, t, g, unknown or other
  misc_feature (619)..(620): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagttctttatggtcggtggtaccanatattangctgactcgtgaaggccattcacatctccagagacgagtccaaggaacagccttgtttctacaaatggacagtctagagacctgacgacacggtctgtctattctgtcgacgagacgaacccgnggggcggancacgccctatcgngggccacggggacccgtnaccgtctcccgtcaccgtcctaccaaccgaacggccctacgttccggtcccttccccgtcggaccctacccccgttacctacgaaacgacgcctacccgttcggtcgggggacaccggaccggccgggtccccgtcggggtcctccggtccgttcgggtaccgaacgggtaccttacctttaaccgtactacgactcggactacggacggtcgggacgtggacgaacggcgaacncgtacgnng

SEQ ID NO: 313005 - DNA, 662 bp, Homo sapiens
  misc_feature: GZ8MTXP02HTZX6.52.53.E09.1.454.CMB.2.raw
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagctcgcagccagaggaacgggcccctaggtacttgatggaggctacaacagtgagtggcacggccacgtaggacggaggggggacccgtagtccccgtgacgttcggccttctccggcgggtccctcccgggtcgttccgtggggtacttgggaccgccggtacctaccctccaacccacgtaccctcccgacgtccctccgtacgtcgtacggacgggacggtaggggttcgaactttacgttacccgtaggtacgaagggtaccggtagggaacctacgtcggggacttaggggttttcgggggttcgggtttaccggggacggggtaaacggggtaccgtaaacgggtttccggacccggtttaaccgtaacgggtccgaccggacccggaacggtccgtaccgtcccccgg

SEQ ID NO: 313006 - DNA, 691 bp, Homo sapiens
  misc_feature: GZ8MTXP02IDP2Q.52.53.E09.1.454.CMB.2.raw
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (690)..(690): a, c, t, g, unknown or other
  misc_feature (690)..(690): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtcccgccaggctccgagggaaggggctgggagtgggtctcaagttctttatggtcggtggtaccanatattangctgactcgtgaaggccattcaccatcnccagagacgagtccaggaacngccttgttctacaaatggacagtctgacgacctgacgacacggtctgtactattactgtgacgagacgaacccggngggggcgganccacgacccccgtatcgcggggcccaacggggaccccggtcacccgttctcccgtacgacgcccctaccaacccgaacggggccccacgttcccgggtcccttccccccgtcggacccctacccccttccctacccgaaacggaccgacctacccgttaccgggttccggggggacccaaccggaccgggcccgggtccccggttcggggccgtaccgggcccgttcggggttaccgaaacgggtacccttaacccgtttaccttaacgtaccgtacgttccggaccgtacgggacggccggggcgtcggggacgaaacgggcccgacgtaacgtacgcgng

SEQ ID NO: 313007 - DNA, 589 bp, Homo sapiens
  misc_feature: GZ8MTXP02I4IKX.52.53.E09.1.454.CMB.2.raw
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgcacagggtctctctcccagcctgtgctgactcaatcgccctctgcctctgcctccctgggacncctcggtcaagctcacctgcactctgancagtggcactacacctacgccatccgcatggcatcagctgcagccagagacggcctggtactgatgagctacaacagtgatcgggacagccaacgaggacggaggggggtacgtacgtcccgtagtacgtcgtctccgtcgacggtccttcccggctcggtacgggtcctaggcgtccggaccttaccctaccaacctacttccgtaccgaacgtcccctacgtaacgttcgacgggtaaacggaccgggtaggggtaactaccgttaaagttccgttagaacggtacggaaccgggttagggaactaaccggtcggtacgtttaagggg

SEQ ID NO: 313008 - DNA, 637 bp, Homo sapiens
  misc_feature: GZ8MTXP02HEOX4.52.53.E09.1.454.CMB.2.raw
  modified_base (606)..(606): a, c, t, g, unknown or other
  misc_feature (606)..(606): n is a, c, g, or t
  modified_base (616)..(616): a, c, t, g, unknown or other
  misc_feature (616)..(616): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagcttgggttttccttgttgtcttaattttaaaaggtgtccagtgtggagtgcgaggtggtggagtcgtgggggaggtcgttggtccagtccgttgggttcggttccctgacgactcctcctgtgcacgcctctggattctccgtcagtacgacaaactacatgacgcgtcgggtccgccaggcctccggaggggacggggcgtgggacggtgggtctacgtaagttcctttagtcggtcggtacggtaccatattattagtcgcgttacgaccgttccggtagggaacgggtccctaattcccaacgtattcccaccgagacgaccgtacgaccgaaaggacctacggtccctttagtttacttaacgaaagtcgggaacctagttcgtaggaacgtcccgtagaccgaacgcggtcttagtccttagttacgtgcgacggagacggaaccggngggggcgacncgaccggtacccgtaagtcgg

SEQ ID NO: 313009 - DNA, 511 bp, Homo sapiens
  misc_feature: GZ8MTXP02HF73H.52.53.E09.1.454.CMB.2.raw
  modified_base (226)..(226): a, c, t, g, unknown or other
  misc_feature (226)..(226): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
tcagcgcagtacgacacgaccggtgctcgatttagagagagtgtgttgggtttgggggctgtgggtccaggaggcagaactctgggtgtctcaccatggcctggatccctctacttcctccccctcctcactctctgcacaggctctgaggcctcctatgagctgacacagccaccctcggtgtctgtgtcctcaggacagacggccaggatcacctgctctgganatgcattgaccaaagcaaatatgcttactcggtacagcagaacgcccggcacggcccctgtctgtcttattataaagtctttgagacgccctcgacggaccctgacgcgacttctctggctcagctcagcgaacaacacgtcacgttcgacctatcgagtcggagtcccgaggcaagaggacgtaggctagactattactgtcagtcatcagacngcagngctacgttatgtctagttcggacgacggaaccaaagtcgaccgtacgtagtcacgacctaggccc

SEQ ID NO: 313010 - DNA, 609 bp, Homo sapiens
  misc_feature: GZ8MTXP02GEJET.52.53.E09.1.454.CMB.2.raw
  modified_base (293)..(293): a, c, t, g, unknown or other
  misc_feature (293)..(293): n is a, c, g, or t
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagctgcagccagagaacgggccctcggtacttgatgaggctcaacngtgatggcagccacgaggcggacgggggacgtactcccgtgactcgcttctcgaggcgtccgctcgtgggactgacgcgctacctcaccatcctccacgtccctaccgagtcgtaggacggacggtagggtcgtaacttagttaccgtggttacgaggtacggtaggggacctaacggtgggtacctaggttttgggggtcgggtttaccgggggacggggtaacggggaaccctaaaggggtttccggaaccccggttaccggttaacgggtacccgtaccggaccccggtaaacgggtcccgtttacccccggg

SEQ ID NO: 313011 - DNA, 647 bp, Homo sapiens
  misc_feature: GZ8MTXP02HRJNG.52.53.E09.1.454.CMB.2.raw
  modified_base (252)..(252): a, c, t, g, unknown or other
  misc_feature (252)..(252): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctccagcctgtgctgactcaatcgcctctgcctctgcctcccgtgggacgcctcggtcaagctcacctgcactctgagcaggtggcactacacctacgcatcgcatggcaatccagcngcacgacgagacggacggtcctaggtactgagtggacgactacaagtagtagagcggacacgacgaacgacgggacggggaacggggtaccgtactaccgtgtacgtcgtcgttcgtcgacggtccgtccggcgtcggtacggacgtcggaccgtcccgtaacctacccaccgtaacctcctacccgacccgtaccgtaccctaccgtacgtcggtaagggaacggtacgggtaggtactaacgtacgttacgtcgtacggacggtacggtacggactcggtacggtagttacggggttcggggtacgggtacggggacgggtaacgtacggtccggtaccgtaccggtaacggtacgaccggtaccggtaccggccgtacccgtcccgtaccgg

SEQ ID NO: 313012 - DNA, 558 bp, Homo sapiens
  misc_feature: GZ8MTXP02JVMYD.52.53.E09.1.454.CMB.2.raw
  modified_base (184)..(184): a, c, t, g, unknown or other
  misc_feature (184)..(184): n is a, c, g, or t
  modified_base (482)..(482): a, c, t, g, unknown or other
  misc_feature (482)..(482): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggancctcggtcaagctcacctgcactctgagcagtgggcactacacctacgccatcgcatggcatcagctgcagccagagaaggccctggtacttgatgaggctcaacagtgatgggcagccagagcgaggggggaccgtactcccgtgactcgcttctcgacgggctccggctcgtcggggactggacgcgtacctacctcaccatcctccagccctcagtcctaggacggacggaggttagacttagttacctgttacgaggtacggtgggacctacgtcggacgtaggttttcggggnggttccggggcgggtaagggaccctagggttccgaccgtccgtaggtacacggacccgaaggcctacggtcccccg

SEQ ID NO: 313013 - DNA, 529 bp, Homo sapiens
  misc_feature: GZ8MTXP02FGFI3.52.53.E09.1.454.CMB.2.raw
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttcctgttgctattttaaaaggtgtccagtgtggagtgcaggtggtggagtcgtgggggagcttggtccagcctggtggttccctgagactctcctgtgcagcctctggattctccgtcagtagcaaactcatgagctgggtccgccaggctccgaggggaaggggctgggagtgggctcgaagtcctttatggtcggtggtaccacatattatgctgactcggtgaaagggccattcaccatctccagagacgagtccaggaacagcctgtttctacaaatggacagtctagacgacctgacgacgacggctgtcttattactgtgcgagacgaacccggagggggcggagcacggccccgtaatcgg

SEQ ID NO: 313014 - DNA, 604 bp, Homo sapiens
  misc_feature: GZ8MTXP02FP6E4.52.53.E09.1.454.CMB.2.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (399)..(399): a, c, t, g, unknown or other
  misc_feature (399)..(399): n is a, c, g, or t
  modified_base (447)..(447): a, c, t, g, unknown or other
  misc_feature (447)..(447): n is a, c, g, or t
  modified_base (603)..(604): a, c, t, g, unknown or other
  misc_feature (603)..(604): n is a, c, g, or t
tcagcgcagtacgacacgaccggtgctcgatttagagagagtgtgtgggtttgggggaggcttggtccagcctggtggttccctgagactctcctgtgcagcctctggattctccgtcagtagcaactacatgagctgggtccgccaggctccgaggggaaggggctggagtgggtctcaagttctttangtcggtgtaccanatattatgctgactcgtgaaggcattcaccatcncagagacgagtccaggaacngccttgtttctacaaatggacagtctgagacctgacgacacggctgtactattactggtgcgaagacgaacccggagggggcggatcacgtcccccgtaagttcgacggggccaacggggacccggtcaccgtctccgtacncgccctaccgaaccgaacgggcccaacgtcccggtccccttcccccgngacccctaccccgttccaacccgaaaggctccctaccgtcgggcggggacccaacggcgttcccgggccgttgggcctacgccgtaggacaacgtcttaccgtcctatacccagtcgcgtacggcggccgggtgaacggacgacggctagagtcgnn

SEQ ID NO: 313015 - DNA, 630 bp, Homo sapiens
  misc_feature: GZ8MTXP02JF7G4.52.53.E09.1.454.CMB.2.raw
  modified_base (219)..(219): a, c, t, g, unknown or other
  misc_feature (219)..(219): n is a, c, g, or t
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (418)..(418): a, c, t, g, unknown or other
  misc_feature (418)..(418): n is a, c, g, or t
  modified_base (565)..(565): a, c, t, g, unknown or other
  misc_feature (565)..(565): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagcttgggttttccttgttgcttaattttaaaaggtgtccagtgtggagtgcagggtggtggagtcgngggggagtcgttggtccaggccgtgggtcggttccctgacgtactctccgtgtgcacgtcctcgtggacttcctccgtnaagtagaccaaacctanatgacgtcgtcgggtcccgcgacggtctaccggagggggaacgggcgtagggacggtcggggtcctaacgtaacgttctttacgtggttcggtacgtaccganattagtactgctgaccgtcgtaggacgggtactactcaccatctaccgagacgacgacgtccgaaggaacacgtccttagttactacaaacgttcggaactagtcgtacgagtaccgacgaacgccgaggtctcgtactacgttacnggtccgacgaacggaacggaaccgggagggggacggacgaccgaccggtacccgtaacggtcggg

SEQ ID NO: 313016 - DNA, 634 bp, Homo sapiens
  misc_feature: GZ8MTXP02F8B9W.52.53.E09.1.454.CMB.2.raw
  modified_base (222)..(222): a, c, t, g, unknown or other
  misc_feature (222)..(222): n is a, c, g, or t
  modified_base (313)..(313): a, c, t, g, unknown or other
  misc_feature (313)..(313): n is a, c, g, or t
  modified_base (381)..(381): a, c, t, g, unknown or other
  misc_feature (381)..(381): n is a, c, g, or t
  modified_base (632)..(633): a, c, t, g, unknown or other
  misc_feature (632)..(633): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagtctttatggtcggtggtaccacatattatgctgactcgngaaggcattcacatctcagagacgagtccaggaacacgccttgtttctacaaatggacagtccgagacctgacgacacgctgtctattacngtgcgagacgaaccggaggggcggagcacgcccccgtacgtcgtcggggccgacgggaaccccggtcnccgtcctccgtcgaccgccctaccgaaccgaacgggacccacgtcccggtcccttcccccgtcggcccgtacccctccctaccgaaacgaccgaccaccgtaccggtcgggggaccaccggacggcccgggtcccggtcgggccgtcggtccggtcggtacgaaccggtacgttaccttacctaacgtacggtaactccggtacgtcggcggaccggggtcgtcgggaaccgacgggccgacagtacgcgnng

SEQ ID NO: 313017 - DNA, 708 bp, Homo sapiens
  misc_feature: GZ8MTXP02HJKQD.52.53.E09.1.454.CMB.2.raw
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
  modified_base (707)..(707): a, c, t, g, unknown or other
  misc_feature (707)..(707): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctggagtgggtctcaagttctttatggtcggtgtaccanattattangctgactcgtgaaggccattcacntcncagagacgagtccaggaacngccttgtttctacaaatggacagtctagacgacctgacgacacggctgtctatactgtgacgagacggaacccggagggggcggagtcgacccggtacccccgtaagttcgcggggacccacggggaaaccccgggtcaaccggtctcccgtacgacgcccctaccgaaccgaacgggccctaacgttccggtcccctttcccccgcggtaccctacccccgttccctaacccgaaacggtaccgcccgtaacccgttccggacggggggacccaaaccggaccgggtcccggggccccgttcgggggccttcgggacccgttacggggtaccgaaaacgggtaccttaaccctttaccgtaaacgttaccggtaacgtccggtacgttcgggaacgggcccgggtactcgggggaccaaacggggtccaccgaaacgttcggacgng

SEQ ID NO: 313018 - DNA, 667 bp, Homo sapiens
  misc_feature: GZ8MTXP02GGGLL.52.53.E09.1.454.CMB.2.raw
  modified_base (184)..(184): a, c, t, g, unknown or other
  misc_feature (184)..(184): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
tcagcgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggacncctcggtcaagctcacctgcactctgagcaggtggcactacacctacgccatcgcatggcatcagctgcagccagaggaacggcctcggtactgatgagctacaacagtgagtcggacacgccaacgaggacggggacggggggtaaccgtacgtcccgtagactcgtcttcgcgcggccgtccggcgtcgtcggggactgggacgccgtacctacccncaaccnctccnccgacnccctcgacgttccgagggacgggtaacggacgggttacgaacgttaacgttactcggtacggaacggtacgggttacgggaacctaacggttccgggtacgtttacgggttttgggggttacggtttaccgggggacgggtaacgggtaaacccggttaacggttaccggtaacccgggtaaccgtttaaacgggtacccgaacccgggtacccggtaaacggtcccggtaccccggttccccccgg

SEQ ID NO: 313019 - DNA, 718 bp, Homo sapiens
  misc_feature: GZ8MTXP02JT9RT.52.53.E09.1.454.CMB.2.raw
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
  modified_base (716)..(717): a, c, t, g, unknown or other
  misc_feature (716)..(717): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctgggagtgggtctcaagttctttatggtcggtggtaccacatattangctgactcggtgaagggccattcacatcncagagacgagtccaaggaacacgccttgtttctacaaagtggacagtctggacgacctgacgacacggtctgtcttattacgtggtcgacgagaacggaacccggaggggggcggaagcaacccggtccccgtaattcgacggggccaacggggaaccccgggtccaccgtctcccgtaccgacgtccctacccaaaccgaaccgggcccctaacggtcccgggtcccctttccccccgcgggtacccctaccccccgtcccgttaacccgaaacgggaccgtccccgtaacccggttcgggtccggggggacccaaacggacccgggtccccggggccccggttggggcccgtttcggacccgggttcgggttaaccgaaaccgggtacccttaaccgtttacccgtaaacgtaccggacggttcccgcgttacggaccggccggggcgtcggacaacggggccgacagtcgnng

SEQ ID NO: 313020 - DNA, 793 bp, Homo sapiens
  misc_feature: GZ8MTXP02I0K8B.52.53.E09.1.454.CMB.2.raw
  modified_base (261)..(261): a, c, t, g, unknown or other
  misc_feature (261)..(261): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaagggctggagtgggtctcaagtctttatgtcggtgtaccacatattatgctgactccgtggaacgggccattcaccatctccagagacgagtccaaggaacngtccttgtttactacaaagtggactagtctagacgaccgtgaccgacgacggtcttacgttacttattacgtggtacggaccggaaaggaaccgggaaacccggggaggggggccggaacgccgaaccccggtacccccgttaacgttccggggaccgggggacccgtaaaccgggggtaacccccgggtcctacccggttccctacccgtaccgacccggtaccccctacccggaaacccggaacccgggtccccgtaccggttccccggttacccccgtttcccccggtaccgaccccctacccccttacccgtaacccgaaacggtacccgcccgtaacccggtcgggtaccggggaccctacggaccgggccccgggtcccggtcggggtccgtccggtacccgtacgggtaacccgtaacggtacccttacccgtttaccgtaacgttaaccgtacgtacccggacgtcgggaccgggtccgggtacgtaacgggaaccgaacgggccgtaacgtacgtacgacgcg

SEQ ID NO: 313021 - DNA, 515 bp, Homo sapiens
  misc_feature: GZ8MTXP02JBG48.52.53.E09.1.454.CMB.2.raw
  modified_base (274)..(274): a, c, t, g, unknown or other
  misc_feature (274)..(274): n is a, c, g, or t
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
  modified_base (386)..(386): a, c, t, g, unknown or other
  misc_feature (386)..(386): n is a, c, g, or t
  modified_base (389)..(390): a, c, t, g, unknown or other
  misc_feature (389)..(390): n is a, c, g, or t
  modified_base (395)..(395): a, c, t, g, unknown or other
  misc_feature (395)..(395): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (477)..(477): a, c, t, g, unknown or other
  misc_feature (477)..(477): n is a, c, g, or t
  modified_base (498)..(499): a, c, t, g, unknown or other
  misc_feature (498)..(499): n is a, c, g, or t
  modified_base (510)..(510): a, c, t, g, unknown or other
  misc_feature (510)..(510): n is a, c, g, or t
  modified_base (514)..(515): a, c, t, g, unknown or other
  misc_feature (514)..(515): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctgggagtgggtctcaagtctttatggtcggtggtaccacatattatgctgactcgtgaaggccattcaccatctcagagacgagtccaggaacagccttgtttctanaaatggacagtcagacgacctgacgacacggtctgtcttattacngtgcgagaacgaaccggngggggcgancaccgcccgtaagtcgnggccgagggacccggcaccgtcnccnncgccncacgagcccagtcgtctcccgtgccaccctcncaagcncacgtcgnggcngcgcgccnggctgcctggacagactactctanacgactcgactcgacgtcggnnggacaggcganagcnn

SEQ ID NO: 313022 - DNA, 617 bp, Homo sapiens
  misc_feature: GZ8MTXP02JWZ00.52.53.E09.1.454.CMB.2.raw
  modified_base (261)..(261): a, c, t, g, unknown or other
  misc_feature (261)..(261): n is a, c, g, or t
  modified_base (451)..(451): a, c, t, g, unknown or other
  misc_feature (451)..(451): n is a, c, g, or t
  modified_base (481)..(481): a, c, t, g, unknown or other
  misc_feature (481)..(481): n is a, c, g, or t
  modified_base (528)..(528): a, c, t, g, unknown or other
  misc_feature (528)..(528): n is a, c, g, or t
  modified_base (559)..(559): a, c, t, g, unknown or other
  misc_feature (559)..(559): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagcttgggttttcctgttgcttaattttaaaaggtgtccagtgtggagtgcgaggtggtggagtcgtgggggagcttggtccagcctggtgttccctgagctctcctgtncagcctctggacttcctccgtcagtagcaaactacatggagcgtcgggtcccgccgaggcctaccggaaggggaacggggccttagggaggttcggggtcctacgtaagttccctttagtcggtcggtacggtacccatagttacttagtcgcttagaacctcggtaggaaacgggcctattaccaactntccaccagacgaacgagtcccaaggaaacnggtccttaggtttctaacaaattcgggaacagttccgagacgtaccnggaccgacacggtcctggtactaacgttcgngacgacgaacggaacggaaccgggagggggacgtacgccgaccgtacccgtacgtcgg

SEQ ID NO: 313023 - DNA, 636 bp, Homo sapiens
  misc_feature: GZ8MTXP02H675P.52.53.E09.1.454.CMB.2.raw
  modified_base (225)..(225): a, c, t, g, unknown or other
  misc_feature (225)..(225): n is a, c, g, or t
  modified_base (299)..(299): a, c, t, g, unknown or other
  misc_feature (299)..(299): n is a, c, g, or t
tcagcgcagtacgacacgaccggtgctcgatttagagagagtgtgttgggtttggggctgtgggtccaggaggcagaactctgggtgtctcaccatggcctggatccctctacttctccccctcctcactctctgcacaggctctggggcctcctatgaactgacacagcccaccctcggtgtcagtgtcctcaggacagacggccaggatcacctgctctgganatgcactgaccaaagcaaatatggttattggtaccagcagaggccaggccacggcccccttattggtgatatanaaggaccatgaagacggccctgagggactcccgtgagcgtacttctcgtcggccttccctccttcgacggggaccaaacgtacgtaccgaccgtttgaactcaacttcgacggtgggaacggtcccggggacgtaacgggaacggggacgaagggtccgtagaaccgttatttaccgttgtaactaaagttaccgaaacgtaagaaccgtaaggttacggttaggtaactttagtgtacgacgtaaggtttcgggacgggtacgggtaacgaacggtcgtacggtaccgtcgtaacggtccgaacggcccgtaaggcccgtaccgtcccccgttccg

SEQ ID NO: 313024 - DNA, 692 bp, Homo sapiens
  misc_feature: GZ8MTXP02G6N93.52.53.E09.1.454.CMB.2.raw
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (271)..(271): a, c, t, g, unknown or other
  misc_feature (271)..(271): n is a, c, g, or t
  modified_base (362)..(362): a, c, t, g, unknown or other
  misc_feature (362)..(362): n is a, c, g, or t
  modified_base (503)..(503): a, c, t, g, unknown or other
  misc_feature (503)..(503): n is a, c, g, or t
  modified_base (691)..(691): a, c, t, g, unknown or other
  misc_feature (691)..(691): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaagggctggagtgggtctcaagttctttatggtcggtgtaccanatattangctgactcgagaacggccatcacatctcagagacgagtccaagaacagtccttgttctanaaagtggactagtctagacgtacctgaacgacacggtctgtacttagtactggacgacgaaggaccggaacccgggaaggggggcggaacncctaccccgggtacccccgttaagtcggtacgggggaccgaaccggggtacccggtccacccgttcctacccgccgacgtccccgtaccgaaacccggacggcccctaggttcccgtcccccgtccctcggaccctccccncgtaccaacggcaccgtaccgtccgggtacggggactaacggccgtcccgggacccgtggggtccctcggtcccgttagggtacccgtaaaacggtcccgttaaaacccttttccggacgttaaaccggtcgttaccggcgtacggaaccggggcgggtacgcgggaacggaacggcgactaagcgang

SEQ ID NO: 313025 - DNA, 591 bp, Homo sapiens
  misc_feature: GZ8MTXP02GTWV2.52.53.E09.1.454.CMB.2.raw
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (590)..(590): a, c, t, g, unknown or other
  misc_feature (590)..(590): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttatgtcggtggtaccacatattatgctgactcgtgaaggccattcaccatctccagagacgagtccaggaacagcctgtttctcaaatggacagtctgagacctgacgacacggctgtctattacngtgcgagacgaacccgngggggcgagcacgccccgtaatcgnggggccaacggggacccggtnaccgtctcctcgacgcctccgaaccgaaacggggcccaacgtcccggtcctttcccccgtggacccaccctccctaccgaagacgccaccgtcgtcgggggcacgaggccggcccgtgggcctcgcctcggtaccaaaggtaccttacttccaacgttacgacttcgccgtacgacggcgggcgtaacggacgaaacgggccaacgacgtacganc

SEQ ID NO: 313026 - DNA, 611 bp, Homo sapiens
  misc_feature: GZ8MTXP02ISE4B.52.53.E09.1.454.CMB.2.raw
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (363)..(363): a, c, t, g, unknown or other
  misc_feature (363)..(363): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggacgcctcggtcaagctcacctgcactctgagcagtggcactacacctacgccatcgcagtgcatcagcngacagccagacggacggccctggtactgatggacgtctanaacgtaggtgagtcgggacacgaccaacgaggacgggacgggggtaaccgtactcccgtagactcgtcttcncgacgtccgtccggcgtcgtcgggactcgacgccgtctacctcgactactccgccacgtcccgtctacgtcgtacgggacggacggtaacgggttagaactttaagtaagtcggtacgacgggacggttacggaccacgttcggacgttacggttgggggtacggttcgggaacggggttagacccgttaaggtccgaacccgtaaggtacgtaccggtacgaccgtaacggtccaccggtcccccgg

SEQ ID NO: 313027 - DNA, 640 bp, Homo sapiens
  misc_feature: GZ8MTXP02HLOTL.52.53.E09.1.454.CMB.2.raw
  modified_base (310)..(310): a, c, t, g, unknown or other
  misc_feature (310)..(310): n is a, c, g, or t
  modified_base (548)..(548): a, c, t, g, unknown or other
  misc_feature (548)..(548): n is a, c, g, or t
  modified_base (601)..(601): a, c, t, g, unknown or other
  misc_feature (601)..(601): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttccttgttgctatttaaaggtgtccagtgtggagtgcaggtggtggagtcgtgggggagcttggtccagcctggtggttccctgagactctcctgtgcagcctcgtggtacttctccgtcagtagactaactacatgagcgtgggtccnccgaggcctccggaaggggaaggggctgggagtcggggtctacgtagtcctttagtgttcggtggtaacactaatagtttatgcttacgacgtccggtaggaaaccggggccctattacccacctattccctacccgaagtacgaacgacgtacccgaaagggaacacggttcctttacgttttacctttagaaaacgttgggaaactcgggttaccaggacgtacctaggaccgacncggggtctacgtacttaaattcgtgtacgacggagaacggaaaccccgggggngggggacgacgccgtaccggtaccccgttaacggtcggg

SEQ ID NO: 313028 - DNA, 665 bp, Homo sapiens
  misc_feature: GZ8MTXP02F972A.52.53.E09.1.454.CMB.2.raw
tcagcgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctcccgtgggagcctcggtcaagctcacctgcactctgagcagtggcactacacctacgcatcgcatggcatcagctgcagccagagaacggcctggtactgatgaggctacaacagtgagtgacgacgccacgaggcggacgggggacgtactccgtgactccgtctcgtcgaggtccgtccggtctcggtgggtaactggacgccgtccctacctccaaccctatcccctccgaaccggtccctaccgtagttccgacggggaacgggacccggggtaagggtacgtaaccgttaacgtttaacgtcgttacgacgggttaacgggaccgggtaaaccgtacggtcggtaaccgttagggtttcgggggttcgggtttaacgggggacggggtaacgggtaaaccggtaggtttaccgtaacccgggtttcgtaaaccggggttacgaacccggtacccgggaaaacggtccccggtttaccccccggg

SEQ ID NO: 313029 - DNA, 574 bp, Homo sapiens
  misc_feature: GZ8MTXP02H5OH4.52.53.E09.1.454.CMB.2.raw
  modified_base (224)..(224): a, c, t, g, unknown or other
  misc_feature (224)..(224): n is a, c, g, or t
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
  modified_base (487)..(487): a, c, t, g, unknown or other
  misc_feature (487)..(487): n is a, c, g, or t
tcagcgcagtacgacacgaccggtgctcgatttagagagagtgtgttgggtttgggggctgtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctgganatgcattgaccaaaagcaaatatgtcttactcggtaaccagacaagaacgcccggaccacggcccctgtccttgtctttaatttaataaaagtacgtttagaagacggtcccttacgaacgggacccctagagcgtactctcgtggctcagcncaggcaacaacgacgtacacgttcgaaccctanaccgaggtcggaacgttcccgagggaccaagggaggaaaccggttggctaggtacttagtaacttgactagaccaanacagacgacgagagacgactactagtgtacgtacgtacggacggacgaacgaacgtaacgtacgtacgtacgacgacgaccgacgcg

SEQ ID NO: 313030 - DNA, 680 bp, Homo sapiens
  misc_feature: GZ8MTXP02IESYG.52.53.E09.1.454.CMB.2.raw
  modified_base (183)..(183): a, c, t, g, unknown or other
  misc_feature (183)..(183): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctccagcctgtgctgactcaatcgccctctgcctctgcctccctgggancctcggtcaagctcacctgcactctgagcagtggcactacacctacgccatcgcatggcatcagctgcagcagaggaacgggccctcggtactttgagtgaggctacaacgagtgatggcagccacgaggcggacgggggacgtactcccgtagacgtccgtacttcgtccgacggtccgtcccgggtcctcggtaggggtaccttggaacggtccgtacccgttaacccgtacccaaccctaactccctcccgaacgtcccctaccgaacgttccgtacggaacgggtaccgggtaggggttaccgtaaacgtttaacgtttaccgttacggttacggtaaggtaaccgggttcggggaaccgtacgtcgggtaccgttagggtttcggggtcggggtttacggggacggggtaacgggtaaccggtaacggttaccggaacccggtaccggttaacggtaccgacggtacccgtaacggtcccgttacccccggg

SEQ ID NO: 313031 - DNA, 604 bp, Homo sapiens
  misc_feature: GZ8MTXP02IKB2Z.52.53.E09.1.454.CMB.2.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (340)..(340): a, c, t, g, unknown or other
  misc_feature (340)..(340): n is a, c, g, or t
  modified_base (466)..(466): a, c, t, g, unknown or other
  misc_feature (466)..(466): n is a, c, g, or t
  modified_base (581)..(581): a, c, t, g, unknown or other
  misc_feature (581)..(581): n is a, c, g, or t
  modified_base (604)..(604): a, c, t, g, unknown or other
  misc_feature (604)..(604): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctgggagtgggtctcaagtctttangtcggtggtaccanatattatgctgactcgtgaagggccattcaccatctcagagacgagtccaggacagcctgtttctcaaatggacagtctagagacctgacgacacggctgtctattactgtgacgagacgacccgagggggcgancgacccgccccgtaattcggcggggaccgtacggggacccggtcacccgtctccctgacgccctaccacgacggccctaacgtcccggtccctacccccgtgacccaccccgttcaccgaagaccnccgtacccgttgggcggggacccacgccggcccgggcccgtcggggctacggccgtcggtacgaaacggtccttaccgttactacgacgactccgcgtaggacggcccggggtancgggaacgacggccagagacgcn

SEQ ID NO: 313032 - DNA, 607 bp, Homo sapiens
  misc_feature: GZ8MTXP02HUYL3.52.53.E09.1.454.CMB.2.raw
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
  modified_base (537)..(537): a, c, t, g, unknown or other
  misc_feature (537)..(537): n is a, c, g, or t
  modified_base (566)..(566): a, c, t, g, unknown or other
  misc_feature (566)..(566): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtcgtgggggagcttggtccagcctggtggttccctgagactctcctgtgcagcctctggattctccgtcagtagcaactacatgagcgtgggtcccncaggctccgaggggagggctggagtgggtcnaagtcctttagngtcggtagtaccatagttacttangctgtacctccggtaggacgggccgtattccacctatcctacccgaagacgacgacgtcccgaaggaaccacgtcccttgttttacttaacaaagttcgggaactagtctaggaacgtcccgtaggaccgtaccgacggtcttcggttaccttaatttccgngtcggacgaaggacggaaaccccgggggngggggacggacgaccgtaccggtaccccgttaacggtcggg

SEQ ID NO: 313033 - DNA, 632 bp, Homo sapiens
  misc_feature: GZ8MTXP02I44X4.52.53.E09.1.454.CMB.2.raw
  modified_base (182)..(182): a, c, t, g, unknown or other
  misc_feature (182)..(182): n is a, c, g, or t
  modified_base (291)..(291): a, c, t, g, unknown or other
  misc_feature (291)..(291): n is a, c, g, or t
tcagcgcagtacgacacgaccggtgctcgatttagagagagtgtgttgggtttggggagctctggggagtctgcaccatggcttggacccactcctcttcctcaccctcctcctccactgcacagggtctctctcccagcctgtgctgactcaatcgcctctgcctctgcctccctgggacncctcggtcaagctcacctgcactctgagcaggtggcactacacctacgccatcgcagtggcatcagctgcacgccaggacgaacggcctggtactgatgaggctcaacngtgagtggcagccacgaggacggagggggtaccgtacgtccgtagacgtcgtcgttcgtcgacggtcgtccggctcgtaggggactggacgtccgtacctaccctacaccctaacttcccacccgacgtccccgttaccgaacgttcgtacgggaacgggtacggtaggggtacgtaaaccgtttagttacgtacggtacggaaggtaccgggtacgggtacctacggtggtacgttagggtttcggggtacggttcggggacggacgggtacgtaacggttaccggtaccggtccgtacgggtaccgacggtccggaacgggtcctacccggtcccccgg

SEQ ID NO: 313034 - DNA, 652 bp, Homo sapiens
  misc_feature: GZ8MTXP02JB1UA.52.53.E09.1.454.CMB.2.raw
  modified_base (343)..(343): a, c, t, g, unknown or other
  misc_feature (343)..(343): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaacgggcctcggtacttgatgaggctcaacagtgatggcacgccacgaggcgagggggaccgtactcccgtgactcgcttcncgaggctccggctcgtgggctgacgcgctacctcaccatcctcccagcccttaccagtccgtaggaacgggaccggtagggtacgaacttagttaacgtcgttacggacggtaacgggttacggggaccctaagtcgggtacgttaaggttttccgggggtttgggtttaccgggggaccgggggtaaacgggggtaaaccccgttaaaggggtttaccggtaaccccgggtttaacccggttaacggggttacccgaaaccgggttaccccgaaaacggggtcccgtacccggtttaccccccccggg

SEQ ID NO: 313035 - DNA, 643 bp, Homo sapiens
  misc_feature: GZ8MTXP02G27PJ.52.53.E09.1.454.CMB.2.raw
tcagcgcagtacgacacgaccggtgctcgatttagagagagtgtgttgggtttgggggctgtgggtccaggaggcagaactctgggtgtctcaccatggcctggatccctctacttcctccccctcctcactctctgcacaggctctgaggcctcctatgagctgacacagcccaccctcggtgtctgtgtcctcaggacaggacggccaggatccacctgctctggagatgctattgaccaaagcaaatatgtacttacgtacggtaccagcaagaacggccccggaccgacggtcccctgtcttgtactttattaataaagtacttgagacgcctcgacgggaccctgacgctacttctctcggcctcacgctcgacgaccgaaccaactacggtactacggttcaaacccattaccgaggtcgggaactcccgaggaccgaaggacggggaacgagggtacctaagtacctttaattaccgtggttaccagtaccaaagttccaaagggtaccaagccgtaaggtcgaaccttacgttaacgttggttacgttaacggtcgggacggggtaaaacggaccctaaaaggttccgggaaaccttacccggtaggtacccgaacgcccggaaacggttccccg

SEQ ID NO: 313036 - DNA, 620 bp, Homo sapiens
  misc_feature: GZ8MTXP02GEKT6.52.53.E09.1.454.CMB.2.raw
  modified_base (264)..(264): a, c, t, g, unknown or other
  misc_feature (264)..(264): n is a, c, g, or t
  modified_base (337)..(337): a, c, t, g, unknown or other
  misc_feature (337)..(337): n is a, c, g, or t
  modified_base (464)..(464): a, c, t, g, unknown or other
  misc_feature (464)..(464): n is a, c, g, or t
  modified_base (618)..(619): a, c, t, g, unknown or other
  misc_feature (618)..(619): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctgggagtgggtctcaagtctttatggtcggtggtaccacatattatgctgactccgtgaagggccattcaccatctccagagacgagtccaggaacngcctgttctacaaatggacagtctgacgcctgacgacacggctgtctattactgtgacgagacggaaacccgngggggcggagcaccgaccccgtaattcggcggggcccgaacggggaaccccggtcacccgtctcccgtcgacgtccctaccgaaccgaacgggccctacgtccggttcccttacccccgtggacccnccccctcctacccgaagaccgcctacccgtcgtcgggggaccaacgcggccgggtcccgtcggggcctcggccgttggccaaagggtcctaccgttcctacgtacgtacgtccgcgtacggacgtcggggctgggccgaacgggcgacagtcgnng

SEQ ID NO: 313037 - DNA, 551 bp, Homo sapiens
  misc_feature: GZ8MTXP02HDV0F.52.53.E09.1.454.CMB.2.raw
  modified_base (259)..(259): a, c, t, g, unknown or other
  misc_feature (259)..(259): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (422)..(422): a, c, t, g, unknown or other
  misc_feature (422)..(422): n is a, c, g, or t
  modified_base (531)..(531): a, c, t, g, unknown or other
  misc_feature (531)..(531): n is a, c, g, or t
  modified_base (550)..(551): a, c, t, g, unknown or other
  misc_feature (550)..(551): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttatggtcggtggtaccacatattatgctgactccgtgaaggccattcacatctcagagacgagtccaggaacngcctgttctacaaatggacagtctagagcctgacgacacggctgtctattactgtcgacgagacgaacccgnggggcgancacgccccgtatcgcgggccagggacccggtcaccgtctcctcacgcctccgaaccgacggcccacgtccgtcccttccccgngccaccctccgaccaacgcgaccaccgtcggcggggccacgacgccggcccgtggcctcgccgtggtcaacggtctaccgttcctatacgctcgctcggacgcgggtcngggaccaaggccgatagcnn

SEQ ID NO: 313038 - DNA, 579 bp, Homo sapiens
  misc_feature: GZ8MTXP02FHHBY.52.53.E09.1.454.CMB.2.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (414)..(414): a, c, t, g, unknown or other
  misc_feature (414)..(414): n is a, c, g, or t
  modified_base (472)..(472): a, c, t, g, unknown or other
  misc_feature (472)..(472): n is a, c, g, or t
  modified_base (578)..(579): a, c, t, g, unknown or other
  misc_feature (578)..(579): n is a, c, g, or t
tcagcgcagtacgacacgaccggtgctcgatttagagagagtgtggttgggtttgggggaggcttggtccagcctggtggttccctgagactctcctgtgcagcctctggattctccgtcagtagcaactacatgagctgggtccgccaggctccagggaaggggctggagtgggtctcaagtctttangtcggtggtaccanatattangctgactccgtgaagggccatcaccatctccaganacgagtccaggaacagcctgttctcaaatggacagtctgagacctgacgacacggctgtctattactgtgcgagagaacccgngggggcgagcacgccccgtaatcgnggggcagggacccgggtcaccgtctctcacgcctcacgaacggcccagtcgccttccccgngcccaccctcctccaagaccgcaccgtcgtcgggggaccacgtacggcccggtcccgnggaccgttcgcccgttaggaccgaaacgggtcctaacgtttcctacgttaccgacgttccggcctgacggccggggcctaagggggacaacgggccgcaactacgnn

SEQ ID NO: 313039 - DNA, 752 bp, Homo sapiens
  misc_feature: GZ8MTXP02IF5ZF.52.53.E09.1.454.CMB.2.raw
  modified_base (258)..(258): a, c, t, g, unknown or other
  misc_feature (258)..(258): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagcttgggttttccttgttgacttaattttaaaaggtgtccagtgtggagtgcgagggtggtggagtcgtgggggagctttgggtccagccgttgggtggttcccgngagctctccgtgtgccagtccctgtggatttcgtccgtcagtagacaaactanatgngtcgtgggtcccaccgaggcctaccggaggggacggggctgggaggtggtctcgtaattccgtttagtcgtcgggtacgtacccagttattatttagtcgccgtttacgaacccgttccggttaagggaaacgggggtaccctagttacccaaacctcttacccgtacccgaaagggaacgtaaccggaacgttacccgaaacgggaacctacggttaacccttttcggtttacctttaaaccgaaagttaccggggtaaatcggttaaccgttggtaaaccggcccgttacgaaccggaaacgtacccggggtttacttacgttacgtttaacgtttacggtacggacgtaacggtaacggaaacccgggtaaccgggggaacgggggaaccggacggtaacccggtacccggtaaccccgtttaacggtccgggg

SEQ ID NO: 313040 - DNA, 664 bp, Homo sapiens
  misc_feature: GZ8MTXP02G7D3Y.52.53.E09.1.454.CMB.2.raw
  modified_base (204)..(204): a, c, t, g, unknown or other
  misc_feature (204)..(204): n is a, c, g, or t
  modified_base (526)..(526): a, c, t, g, unknown or other
  misc_feature (526)..(526): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaagggctggagtgggtctcaagtcttttagtggtcggtcgtaccanattattagtcgctgaccgttccggtaggaacggggcctattccactatcctccagacgacgacgtaccaaggaacagtccttgttactacaaagtggactagtctagacgacctcggaacgaccgcgggtcttcggttacttacttacgtggtcgacggaaggaaccggaacccggggaggggggccgagccgacccggtacccccgttagtcggacggggaccgaaccggggacccggtccgtacccgtctccgtcgaccgccctaccgaccgacgccctacgtccgtccctcccgtccgccctccctcctaccgagaccnccacgtcggtcggcacgccggccgccggcggtctcggtccgtaggtaccgaacggtacttaccgttaccgtacgtaccgtacgtccgtcgacggacggtccggacgtcggacgaacgggtcgacgtacgtacggcgcg

SEQ ID NO: 313041 - DNA, 600 bp, Homo sapiens
  misc_feature: GZ8MTXP02JKWUK.52.53.E09.1.454.CMB.2.raw
  modified_base (145)..(145): a, c, t, g, unknown or other
  misc_feature (145)..(145): n is a, c, g, or t
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (339)..(339): a, c, t, g, unknown or other
  misc_feature (339)..(339): n is a, c, g, or t
  modified_base (600)..(600): a, c, t, g, unknown or other
  misc_feature (600)..(600): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccnccaggctccagggaagggctggagtgggtctcaagtctttangtcggtgtaccanatattatgctgactcgtgaagggccattcaccatctcagagacgagtccaggaacagcctgtttctcaaatggacagtctgaagacctgacgacacgggctgtctattacnggtncgagagaacccgagggggccggancaccgtaccccgtaatcgaggggaccaacggggtacccggtcaccgtctccgtacacgtccctaccaacccgaaccggacccgacgtccgtcccgttccccgtccgaccacccctaccctaccgaacgacgaccgacctaccgtcgggacgacgacgccggcccgtcggcgtcgccgtcgtacgaacgtaactaacttacctacgtaacgtacgtcgtacgtcgacggcggacgaacggacgaacggacgacgactacgan

SEQ ID NO: 313042 - DNA, 636 bp, Homo sapiens
  misc_feature: GZ8MTXP02FOBWA.52.53.E09.1.454.CMB.2.raw
  modified_base (314)..(314): a, c, t, g, unknown or other
  misc_feature (314)..(314): n is a, c, g, or t
  modified_base (361)..(361): a, c, t, g, unknown or other
  misc_feature (361)..(361): n is a, c, g, or t
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgcacaggtctctcctccagcctgtgctgactcaatccgccctctcgcctctcgccctcccgtgggacgccttcggtacaacgtcctacacctcgcactctgacgcgagtggcactaccacctacgccatcgcagtcgctatcagtcncgcaagccgaaggacggaacgggcctcgtatgagtgaggctacaagngtgagcggacacgaccgtaagcgggacgggaacgggggtataccgccgtagtacgtcgtcttccgacgtcgtccgtacggtcttcggaccggttaagtcggaccgtaaccgtcccgttaacccaccgtaaccttcctcccggttaaccccgaccgtccgtacgtacggtacggtaacgggtacgggtaaacgggtacggttaacgttacgttaacgttcgtacggtaacggtaacgggtacggtacgggtactacggtacggttaggtttacggg

SEQ ID NO: 313043 - DNA, 599 bp, Homo sapiens
  misc_feature: GZ8MTXP02GD8JG.52.53.E09.1.454.CMB.2.raw
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggacgcctcggtcaagctcacctgcactctgagcagtgggcactacacctacgccatcgcatggcatcagctgcagccagaggaacggccctcggtacttgatgaggctacaacagtgatgggcagccagaggcggagggggaccgtactcccgtgactcgtcttctcgacggtcgtccggtctcgtcgggactggacgcgtacctacctcacctactccaccacgccctctacgtcgtaggaacggacggtagggtacgtaacgttagttactacggttacgacggtacgggttacgggaacgtaccgtagggtcgtaggtttgggggtcggtttcggggacgggacgggtaaccgtaacggttccggaccgtcggtacgggtcaccggacccgtaacggtccgtaccggtcccccgg

SEQ ID NO: 313044 - DNA, 774 bp, Homo sapiens
  misc_feature: GZ8MTXP02I5GJC.52.53.E09.1.454.CMB.2.raw
tcagcgcagtacgacacgaccggtgctcgatttagagagagtgtgttgggtttgggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaaagcaaatatgcttactggtaccagcaagaacgccccggccacggcccctgtcttgtctttatttaataaagtactttgagacggccctcgacgggacccctagacgtcgtacttcctcgtcggccttaccaacgtcctcgacggaccgaacaaaccgtacgtacgtaaacgtttacgaaccctaattaccgaagggttacggggaacgttaccccgaaaggggcccgaaagggaacggggaaccgggtagggaccgtttaacgggaaaccctttaaaggtttaaaccgttcgggttaacccaagggtttaccaaaacggttaccaaacgggtaaccctaaaaggcccgtaaagggtttccgggaacccttaacggtttaaacgttggtttacccggttaaagtttcccgggggaaccggggtaaaaccgggggaaccccttaaaaaacggtcccgggtaaaacccccggtttaccgtaaaaccgggggtttaccctaaaacccgggaacccccggtaaaacgggggtttcccccg

SEQ ID NO: 313045 - DNA, 700 bp, Homo sapiens
  misc_feature: GZ8MTXP02GCZ8R.52.53.E09.1.454.CMB.2.raw
  modified_base (246)..(246): a, c, t, g, unknown or other
  misc_feature (246)..(246): n is a, c, g, or t
  modified_base (312)..(312): a, c, t, g, unknown or other
  misc_feature (312)..(312): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttccttgttgcttatttaaaaggtgtccagtgtggagtgcaggtggtggagtcgtgggggagcttggtccagcctggtggttcccngagactctcctgtgcagcctctggtacttcctccgtcagtagcaaactacatgagcgtagggtccnccgaggcctaccggaaggggacggggcgtgggacggttggggtacctacggtaacgttcccgtttagtcggtcgggttacggtaaccactaatttacgttagtcgacgttagtacccgtacgggttaggaaaccggggtcctattacccgactactcgtaccaagacgacgaacgtcccgaaaggaacctacgtccttacggtttacttaacgaaagttcgggaacctagtcccgtagaacgtaacccgtggaacccgacgaccgtcgtttacgttacttaaccggttacgtggttaccggaacgaaggtaaaacccggggaaccggggttacggggggaacggaccggaccgttaaccggggtaacccccgtttaacggtccggggg

SEQ ID NO: 313046 - DNA, 680 bp, Homo sapiens
  misc_feature: GZ8MTXP02FMG94.52.53.E09.1.454.CMB.2.raw
  modified_base (269)..(269): a, c, t, g, unknown or other
  misc_feature (269)..(269): n is a, c, g, or t
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (415)..(415): a, c, t, g, unknown or other
  misc_feature (415)..(415): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagctgggttttccttgttgctatttaaaggtgtcagtgtggagtgcaggtggtggagtcgtgggggagtcgttggtccagccgtggtcggttccctgacgactctcctgtgcagcctntggattcctccgtcagtanacaactacatgagcgtcggggtcccnccaggcctaccggaaggggaacggggtctggggaggttggggtacctacgtaaagttcccttttagcggttacggtacggtaaccctataatttagttagngtcctacgaccttcccggtaagggaacggggcccgtattccaaccctacttcacccgagtacgacgacgtaccgaaaggaacctaggtccctttaggttttcctaacgaaaagtcgggtaaacacggtctaggacgaacctggaacgaccgaacggtctacggttacttaaacgttcgtggttcgaaccgggaaggaacccggaaaccccggggtgggggaccgggacgaccggtaccggaaccccggttaacgtttcccggggg

SEQ ID NO: 313047 - DNA, 656 bp, Homo sapiens
  misc_feature: GZ8MTXP02FNEZ0.52.53.E09.1.454.CMB.2.raw
  modified_base (145)..(145): a, c, t, g, unknown or other
  misc_feature (145)..(145): n is a, c, g, or t
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (419)..(419): a, c, t, g, unknown or other
  misc_feature (419)..(419): n is a, c, g, or t
  modified_base (655)..(656): a, c, t, g, unknown or other
  misc_feature (655)..(656): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccnccaggctccgagggagggctggagtgggtctcaagttctttangtcggtgtaccanatattangctgactccgtgaagggccattcacatcncagagacgagtccaaggaacagcttgtttctacaaatggacagtctagacgacctgaccgacacggtctgtacttattactggtgacgagaaccggaaaccccggaggggggcggagccgaccccggtacccccgttaaacgtcggtacgggggaacccgaaccgggggtaacccccgggtnaaaccggtcctaccgtaccgaccgccctacccgaaccgaaaccggggccccaacggttcccggtccccttccccccgtgacccctaacccccttcccgtacccgaaacgaccgcccaacccgtcggtcgggggaccacgcggcccgggcccgtggggcctcgccgtcggtacaacggtactacctactagtacgactcgacgtcgacgcgggtcaacgggacaacgggcacaatgnn

SEQ ID NO: 313048 - DNA, 733 bp, Homo sapiens
  misc_feature: GZ8MTXP02H8Y3R.52.53.E09.1.454.CMB.2.raw
  modified_base (323)..(323): a, c, t, g, unknown or other
  misc_feature (323)..(323): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagttgggctgagctgggttttccttgttgcttattttaaaaggtgtccagtgtggagtgcgaggtggtggagtcgtgggggagcgttggtccagtccgtgggtcggttccctgacgacttcctcctgtgcacgcctcgtggacttccgtccgtcagtacgaccaactacatgagcgtggcccnccgagctaccggaggggagggctggagtggtcngtaagtcttagngtcggtcgtaccacgtattatatcgcgtgacctcggtagaacggcccgtatccgactacttccgaccgaagacgacgtacgtacccgaaaggaaccgtacgttacccgtttcgttttaccgttaaaccgtaaaaggttacggggtaacctaacggttaccgtacggtaaccggtaacccgttacgggaaacccgtaaccggtaacccgggtcttaacgggttacctttaaacgttaaccggttggttaccggaaccgggtaaacgggaaacccgggtaaaaccccgggggacggggggggtaacccggaacgggtacccggaaccccgggttacccccgggtttaaaaccggtttccccgggggg

SEQ ID NO: 313049 - DNA, 694 bp, Homo sapiens
  misc_feature: GZ8MTXP02FFQPH.52.53.E09.1.454.CMB.2.raw
  modified_base (183)..(183): a, c, t, g, unknown or other
  misc_feature (183)..(183): n is a, c, g, or t
  modified_base (290)..(290): a, c, t, g, unknown or other
  misc_feature (290)..(290): n is a, c, g, or t
  modified_base (412)..(412): a, c, t, g, unknown or other
  misc_feature (412)..(412): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctcctgggancctcggtcaagctcacctgcactctgagcagtggcactacacctacgccatcgcatggcatcagctgcagccaaggagaacggccctggtactgatgaggctcaacngtgaagtggcacgacccacgaggacggacggggggacccgtacgtcccgtagactcggtccttcgtcgacggccgtccggcttcgtcgggactcgacgccgtacctacctcacctattcccnccacgcccctcgacgtcgtaggacgggaccgggtagggtacgtacttacttacgtcgtacgaacggtacgggtacgggaaccgtaacgttcgggaccggtttaagggttttcgggggtcggggtttacccgggggaaaccgggggtaaaccgggggttaaacccccgttaaagggggttacccggtaaccccgggttaacccgggttaaacggggttcccgaaaccccggggttaccccggtaaaaccggggcccccgttaccccgggttaccccccccggg

SEQ ID NO: 313050 - DNA, 696 bp, Homo sapiens
  misc_feature: GZ8MTXP02JN216.52.53.E09.1.454.CMB.2.raw
  modified_base (211)..(211): a, c, t, g, unknown or other
  misc_feature (211)..(211): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggacgcctcggtcaagctcacctgcacttcngagcaggtggcactacacctacgccatcgcatcggcactcagctgcagccaggaggaacggcctcggtacttgatggacggctacaacgagtgagtcggcacgccaacgagacggggagggggtacccgtacgtcctgtactcgtacttcgcgacggtcctccggcgtcgtgggactggacgccgtacctaccgtcacgtaccgtctacccgatcccgtacgacgttcgaagggacgggtaccggtagggttactacgtttacgtttacgtacggtacggaagggtaccggtacgggtaacgtacgggttgggaccgttttaagggggttttcgggggttcggggtttaacccgggggacgggggttaacgggtaaacccggttaaacgggttcccggtaaacccggtttcccgggaacggggtttaccccgaaccggggttaccccgaaacggggtttcccccgaccgggtttacccccccggg

SEQ ID NO: 313051 - DNA, 715 bp, Homo sapiens
  misc_feature: GZ8MTXP02GX736.52.53.E09.1.454.CMB.2.raw
  modified_base (214)..(214): a, c, t, g, unknown or other
  misc_feature (214)..(214): n is a, c, g, or t
  modified_base (307)..(307): a, c, t, g, unknown or other
  misc_feature (307)..(307): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacagggtctctctccagcctgtgctgactcaatcgccctctgcctctgccctcccgtgggacgcctcggtcaagctcacctgcactctgancaggtggcactacacctacgcctatgcatcggcatcagctgacacgccagacgaacggtccctacggtacttgagtggacggctacgaaacgnggtgaagtcggacgacgaccgaacgagggacgggaaggggggtaccccgtacgtccctggaactccggtactttcgaccgtacgggtcccgtcccgggtccgtacggtacgggaactcggacgccgtaccctacctaccacctaactccgtaccgacgtccctacgacgttcgacggacggacggtagggtagtaaccttagtttaaccgcggttacgacgggttaacgggtacggggaaacctacggttcgggaaaccgtttacggttttacgggggtcggtttaccgggggaacgggtaaccggggtaaccgttaaaacgggttccggtaacccggttaaccgggtttacggaacccggaccggtaacccggaaaccgggtcccgtttacccgggtacccccccgg

SEQ ID NO: 313052 - DNA, 577 bp, Homo sapiens
  misc_feature: GZ8MTXP02HT2TA.52.53.E09.1.454.CMB.2.raw
  modified_base (344)..(344): a, c, t, g, unknown or other
  misc_feature (344)..(344): n is a, c, g, or t
  modified_base (401)..(401): a, c, t, g, unknown or other
  misc_feature (401)..(401): n is a, c, g, or t
  modified_base (553)..(553): a, c, t, g, unknown or other
  misc_feature (553)..(553): n is a, c, g, or t
  modified_base (569)..(569): a, c, t, g, unknown or other
  misc_feature (569)..(569): n is a, c, g, or t
  modified_base (576)..(577): a, c, t, g, unknown or other
  misc_feature (576)..(577): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggtaaggggctggagtgggtctcaagtctttatgtcggtggtaccacatattatgctgactccgtgaagggccgattcaaccatctccagagacgagtccaggaacagcctgttcttacaaatggacagtctgacgacctgacgacgacggctgtctattactgtgcgagacgaacccgaggggcggngcacgccccgtaacttcgtcggggccacggggaacccgggtcaccgtctccctcacnccctaccacccgaacggcccagtccgtccctcccccgtgcccaccctccctcaagcgccaccgtcgtgggggcacacggccggcccctgggcctcggccctgggtaccaaggcttaccttactacgtaccggatcgacgtcgcggcggggcngggaccgaagggccanaacgtgnn

SEQ ID NO: 313053 - DNA, 659 bp, Homo sapiens
  misc_feature: GZ8MTXP02JXIIK.52.53.E09.1.454.CMB.2.raw
tcagcgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatccgccctctgcctctcgccctcccgtggggacgccctcggtcaagctcacctgcactctgagcaggtggcactacacctacgccatcgcagtcggcatcagctgcagccaggaggaacgggccctggtacttgatggacgctacaactggtgagtcggcgagccaacgaggcgggagggggaccgtacgtccgtagacgtcgtacttccgtccggacgggtcccgttccggtccgtcgggtcgggtaccgtgggacgcccgtcctacccgtccacctacttcccaccgtacgtccctaccgacgtcgtagggaacgggtacggagggttacgtacgttacgttacgtacgtacggtacggtaacgggtacgggtacgtaccgggtggtaccggttagttttcgggggtcggtacgggggtcggggtaacgggtacgtaacggttcggtaaccggttccggtacggtaccgaccggtacgacggttccgcccggtacccccgg

SEQ ID NO: 313054 - DNA, 620 bp, Homo sapiens
  misc_feature: GZ8MTXP02HQ4AX.52.53.E09.1.454.CMB.2.raw
  modified_base (261)..(261): a, c, t, g, unknown or other
  misc_feature (261)..(261): n is a, c, g, or t
  modified_base (484)..(484): a, c, t, g, unknown or other
  misc_feature (484)..(484): n is a, c, g, or t
tcagcgcagtacgacacgaccggtgctcgatttagagagagtgtgttgggtttgggcacgaccggtgctcgatttagagagagtgtgttgggtttggggagcagagctctggggagtctgcaccatggcttggaccccactcctcttcctcaccctcctcctccactgcacagggtctctctcccagcctgtgctgactcaatccgccctctgcctctcgccctcccgtgggacgcctcggtcaacgctcacctgcactcngacgcaggtggcactaccacctacgccatcgcatggcatcgagctcgaccagccgaaggaacggaaacgggtccccgtacggtacttaggagtacgacggctacaacgaggtgagtcgacgacgccgaagcggacgggacgggggtactacgtccgtagactccgtactccgtacgtcgccgtccgctcggtcggactcggacgccgtcctaaccctcacccncgttcctcccgacgtccctccgtaacggttccgaggtacggggacggtacggggttaactaacgttaacttaccggtacgtaacggtacgtaccggggttacggaaaccgttacggtcggttaacgtttacggggg

SEQ ID NO: 313055 - DNA, 607 bp, Homo sapiens
  misc_feature: GZ8MTXP02FLMKQ.52.53.E09.1.454.CMB.2.raw
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
  modified_base (266)..(266): a, c, t, g, unknown or other
  misc_feature (266)..(266): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (338)..(338): a, c, t, g, unknown or other
  misc_feature (338)..(338): n is a, c, g, or t
  modified_base (416)..(416): a, c, t, g, unknown or other
  misc_feature (416)..(416): n is a, c, g, or t
  modified_base (599)..(599): a, c, t, g, unknown or other
  misc_feature (599)..(599): n is a, c, g, or t
  modified_base (605)..(606): a, c, t, g, unknown or other
  misc_feature (605)..(606): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgaggggaaggggctgggagtgggtctcaagttcttttanggtcggtggtaccanatattatgctgactccgtaggaacgggcattcacatcaccagacgcgagccaggaacngtccttgtttctacaaagtggacagtcngancctgacgacacggntgtctattctgtgacgagacgaccggngggggacggacgctaccgacccccgttagtcggtcggggacccggaccggggaccggtcaccgtctccgcgacgtccncccgaacgacggcccgtacgtccgtccctccccgtcgtcccaccctcctaccgacgacgacgacccgtcggcggggacacgccggccgggtcccgcgggccgtcgccgtaggtaccgaacgtaccttacctactacgtacgtacgtcgtcgtcggacggccgggtacgcggacgacggccganacgcgnng

SEQ ID NO: 313056 - DNA, 563 bp, Homo sapiens
  misc_feature: GZ8MTXP02HU11T.52.53.E09.1.454.CMB.2.raw
  modified_base (202)..(202): a, c, t, g, unknown or other
  misc_feature (202)..(202): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (562)..(562): a, c, t, g, unknown or other
  misc_feature (562)..(562): n is a, c, g, or t
tcagcgcagtacgacacgaccggtgctcgatttagagagagtgtgttgggtttggggaggcttggtccagcctggtggttccctgagactctcctgtgcagcctctggattctccgtcagtagcaactacatgagctgggtccgccaggctccgaggggaagggctggagtgggtctcaagtctttatgtcggtggtaccanatattatgctgactcgtgaaggccattcacatctcagagacgagtccaaggaacagccctgtttctacaaatggacagtctgagacctgacgacacggctgtctaattactgtgcgagaacgaacccgagggggcggancacgccccgtaattcgnggggccaggggacccgtnacgtcncnacnccacacacgccatccgtcctcccgcgccaccctccacaacgcgacctaccgtcggtcgggacacgacgccggcccgtggcctcgccgtacggacgaacggtaccttaacttaccgtaacgtacgacgtcgcgtacgacggacggcggtcggacggacggacgacgacgtacgagng

SEQ ID NO: 313057 - DNA, 677 bp, Homo sapiens
  misc_feature: GZ8MTXP02JRF9U.52.53.E09.1.454.CMB.2.raw
  modified_base (207)..(207): a, c, t, g, unknown or other
  misc_feature (207)..(207): n is a, c, g, or t
  modified_base (275)..(275): a, c, t, g, unknown or other
  misc_feature (275)..(275): n is a, c, g, or t
  modified_base (523)..(523): a, c, t, g, unknown or other
  misc_feature (523)..(523): n is a, c, g, or t
  modified_base (651)..(651): a, c, t, g, unknown or other
  misc_feature (651)..(651): n is a, c, g, or t
  modified_base (677)..(677): a, c, t, g, unknown or other
  misc_feature (677)..(677): n is a, c, g, or t
tcagcgcagtacgacacgaccggtgctcgatttagagagagtgtgttggggtttgggggaggcttggtaaaggcggggggggtatctgagactctcctgttcagtctctggattcaccttaaataactatggcatgagctgggtccgccaggctccgaggggaaggggctgggagtgggtctcatttatcagtggtactggtggtancacatactacgcagactccgtgaacgggccgttcaccatctaccaaagacaattccaaagaacacgtntagttattaacaaatgaacagcctgagacgaccgaaggacacggaccgtaatacttactgtagagaaatctctcccacgtcctcccgtcccccgttgacgttggtttacttcccgactccgtcggggaccgtacggtaaccctagtccgtccgtcctcctacgacgccctacccgaaccgaacgggcccctacgtcccgttcccgttacccccgtcggtcccaccccgttccctaccaacgggtaccncctaacccgtcgggtcggggaccaccgacgggtcccgggcccgtcgggccgttccggaccgtagggtacccgaaacggttaccttaccctttcgaaacgtacgacgttcgcgtacggacggtccgggngtcggaacgacggcgtacacgtgcgn

SEQ ID NO: 313058 - DNA, 573 bp, Homo sapiens
  misc_feature: GZ8MTXP02F2MYI.52.53.E09.1.454.CMB.2.raw
  modified_base (230)..(230): a, c, t, g, unknown or other
  misc_feature (230)..(230): n is a, c, g, or t
tcagcgcagtacgacacgaccggtgctcgatttagagagagtgtgttgggtttgggggctgtgggtccaggaggcagaactctgggtgtctcaccatggcctggatccctctacttcctccccctcctcactctctgcacaggctctgaggcctcctaaatgagctgacacagcccaccctcggtgtctgtcgtcctcaggacagacggccaggatcacctgctctgganatgcattcgacaaagcaatatgcttactggtaaccagcaagaacgcccggccacggcccctgtcttgctttaatttaataaagtactttgagacggccctacgacggacccctgacgcgtactttcgtctggcctcgtacgctcgacgaccgaaacaaaccagtactaccgttgaaccactcgtaggtggacgtaccgagcgaacggaggacggagcgtagtaactagttactgtactagtcatcaaggacaagcaggtcgactacgttactggtcgttacggtcggacgggtaacggacaaacgtcgtaaccgtacgtacggtccgacgcccgtaacgcccg

SEQ ID NO: 313059 - DNA, 714 bp, Homo sapiens
  misc_feature: GZ8MTXP02HNEG8.52.53.E09.1.454.CMB.2.raw
tcagcgcagtacgacacgaccggtgctcgatttagagagagtgtgttgggtttgggggagctctggggagtctgcaccatggcttggacccactcctcttcctcaccctcctcctccactgcacagggtctctctcccagcctgtgctgactcaatcgccctctcgcctctcgcctcccgtgggacgcctcggtcaacgctcacctgcactctgagcaggtcgggcactacacctacgcctatcgcatggcatcagctcgcagaccgaagacggaacggcccgtacggtacttgatgtacggactacgaacaggtagacgtgacgacgcaacggacggacgggaacgggggtacccgtacgtccgtacgtacgttcgtccgttccgcggtacggtcccgtccggtccgttcggtacgggttacgcgggacgtacggtacccttacccgtacctacctaacttccctacccgacggtccctacggtacgtcggtacgggaacggtacggggtaacggtttacgactttaacgttacgtacggtcgtaacgggtacggtacggacgtacggttacgggacgtttagggtttcggggtacgggtttacgggggacggggtaaccggtaaccggtacgggttaaccggtacccggttaaccggttacggtaccggaccgggtaccgtaaacgggtcccgtttaacccggtacccccgg

SEQ ID NO: 313060 - DNA, 636 bp, Homo sapiens
  misc_feature: GZ8MTXP02FKWZ0.52.53.E09.1.454.CMB.2.raw
  modified_base (274)..(274): a, c, t, g, unknown or other
  misc_feature (274)..(274): n is a, c, g, or t
  modified_base (383)..(383): a, c, t, g, unknown or other
  misc_feature (383)..(383): n is a, c, g, or t
  modified_base (450)..(450): a, c, t, g, unknown or other
  misc_feature (450)..(450): n is a, c, g, or t
  modified_base (475)..(475): a, c, t, g, unknown or other
  misc_feature (475)..(475): n is a, c, g, or t
tcagcgcagtacgacacgaccggtgctcgatttagagagagtgtgttgggtttggggagctctgggagaggagcccagcactgggattccgaggtgtttccattcagtgatctgcactgaacacagaggactcgccatggagtttgggctgagcttgggttttccttgttgctattttaaaaggtgtccagtgtggagtgcaggtggtggagtcgtgggggaggcttggtccagccgtgggtcggttccctggacgactctcctgtgcagcctnggtattctccgtcagtagacaactacagtgacgcgttcgggtcccgccgaggcctaccggagggggtaacggggcgtgggaggtcggggtctacgtaagttcctttagnggttcggtacggtaccactattattatgtctgaccttcggtaggacgggactacttccacacttccncgagacgtacgacgtccgaagaacncgtccttgtttacttaagaaatcggacacgttcaggacgtacctagaacgacgaaccggtcttacggtacttacgtttacgtggtacgacggacggaaaccggaacccggggacgggggcggaaccgccgaaccgggttacccccgtaaggtttcccgggg

SEQ ID NO: 313061 - DNA, 537 bp, Homo sapiens
  misc_feature: GZ8MTXP02GWP9L.52.53.E09.1.454.CMB.2.raw
  modified_base (188)..(188): a, c, t, g, unknown or other
  misc_feature (188)..(188): n is a, c, g, or t
  modified_base (335)..(335): a, c, t, g, unknown or other
  misc_feature (335)..(335): n is a, c, g, or t
  modified_base (451)..(451): a, c, t, g, unknown or other
  misc_feature (451)..(451): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (518)..(518): a, c, t, g, unknown or other
  misc_feature (518)..(518): n is a, c, g, or t
  modified_base (529)..(529): a, c, t, g, unknown or other
  misc_feature (529)..(529): n is a, c, g, or t
  modified_base (536)..(537): a, c, t, g, unknown or other
  misc_feature (536)..(537): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttangtcggtggtaccacatattatgctgactcgtgaagggcattcaccatctccagagacgagtccaggaacagcctgttcttcaaaatggacagtctgagacctgacgacacggctgctatactgtgcgagagaacccagggggcggancgacgcccccgtaatctggggccaggggaacccgggtcaaccgtctccgtcagccctaccaccaaacgggcccatcggtccttcccccgtgcccacccctcctccaagacgcaccncgtagggggcacgagcggccnggcngcctggcaaggactacgtctatacgactcgctgacgcgggcncggcaacggcncgacagnn

SEQ ID NO: 313062 - DNA, 680 bp, Homo sapiens
  misc_feature: GZ8MTXP02F86XK.52.53.E09.1.454.CMB.2.raw
  modified_base (646)..(646): a, c, t, g, unknown or other
  misc_feature (646)..(646): n is a, c, g, or t
tcagcgcagtacgacacgaccggtgctcgatttagagagagtgtgttgggtttgggggctgtgggtccaggaggcagaactctgggtgtctcaccatggcctggatccctctacttcctccccctcctcactctctgcacaggctctgaggcctcctatgagctgacacacgcccacccgtcggtgtctgtcgtcctcaggacaggacggccaggactccacctgctcgtaggagatgctattcgaccaaagcaatatgtacttacgtgtaaccagacaggaaccgccccggccgaccggtcccctgtcttcgtactttaagtttaacaacgttactttggaacggtaccggtccctacggacccggtcccctaggacgtcgtactttccctcgcggtcctcgacgtcctcgacgactaaacaaaccgtgtacgtacggtacacctagtacgaggtacggacgtcccgaacgggcaaggggaacgggtaaccgtaacgggcctttaaagggtaccttttaaacgttaccgttacggttaacctacgggttaaccaacgttacgaacggaacccaaggtccgtaaggtcgtaccttaaagtttcgtacggtacgttacggacgggtacggaaccgaacgtaaaccgngtacccgtacgtagccgtaccgaccgagtccccg

SEQ ID NO: 313063 - DNA, 651 bp, Homo sapiens
  misc_feature: GZ8MTXP02I3E9V.52.53.E09.1.454.CMB.2.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
  modified_base (650)..(650): a, c, t, g, unknown or other
  misc_feature (650)..(650): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaagggctggagtgggtctcaagtctttatgtcggtggtaccanatattatgctgactccgtgaagggccattcaccatcncagagacgagtccaggaacngccttgttctacaaatggacagtccgagacctgacgacacggctgtctaattactgtgacgagacgaacccgagggggcggagcgacgcccccgttaagtcgaggggccgacggggaaccccgggtcaccggttcctcctcgaccgtccctaccaaccggtaaacgggccctaagttcccggttccctaccccccgttgggacccctaccccttaccctaccgaaacgtaccgacctacccgtacgggtcgggggaccaacgcggccccgggcccgttggggcctcggtccgtgggtaacctaagggaccttaccgtttaccaagtacggattcccggcgttagggaccggtacggggctacgggaacgaacggccggacagtacgcgacng

SEQ ID NO: 313064 - DNA, 677 bp, Homo sapiens
  misc_feature: GZ8MTXP02ITUSK.52.53.E09.1.454.CMB.2.raw
  modified_base (211)..(211): a, c, t, g, unknown or other
  misc_feature (211)..(211): n is a, c, g, or t
  modified_base (260)..(260): a, c, t, g, unknown or other
  misc_feature (260)..(260): n is a, c, g, or t
  modified_base (448)..(448): a, c, t, g, unknown or other
  misc_feature (448)..(448): n is a, c, g, or t
  modified_base (675)..(676): a, c, t, g, unknown or other
  misc_feature (675)..(676): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaagggctggagtggtctacaagttctttatggtcggtgtaccatattattangctgactcgtagaacggcctatcacatcacagagacgatccaaggaacngtcctttgttctacaaagtcggaactagtcgtagacgtacctaggacgacgacggtctcgtacttattacgtggtcgtacggaaacggaaccggaaccccgggaggggggccgaacgccgtaaccccggtacccccgttaagttccggaccgggggaccgaaccggggtaaccccgtctacccgttcnccctaccgacgcccctaaccgaccgaccggacctccgttaccgtccccgttcccgcgaccctacccgtacctaccgaacgaccgcctaccgtccggtacgggacctaacggccggcccgggtcccgcggtccgtacggcgtacggtaaccgacgtaccgttaaccttaccgtacgtaacgtccgtacgcggtacggcggtaccgggcgaacggacgacggcagcagnng

SEQ ID NO: 313065 - DNA, 691 bp, Homo sapiens
  misc_feature: GZ8MTXP02GQCET.52.53.E09.1.454.CMB.2.raw
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (240)..(240): a, c, t, g, unknown or other
  misc_feature (240)..(240): n is a, c, g, or t
  modified_base (356)..(356): a, c, t, g, unknown or other
  misc_feature (356)..(356): n is a, c, g, or t
  modified_base (382)..(382): a, c, t, g, unknown or other
  misc_feature (382)..(382): n is a, c, g, or t
  modified_base (690)..(691): a, c, t, g, unknown or other
  misc_feature (690)..(691): n is a, c, g, or t
tcagcgcagtacgacacgaccggtgctcgatttagagagagtgtgtgggtttgggggaggcttggtccagcctggtggttccctgagactctcctgtgcagcctctggattctccgtcagtagcaactacatgagctgggtccgccaggctccgaggggaaggggctgggagtgggtctcaagttctttatggtcggtggtaccanatattangctgactcgtgaaggccattcacatcncagagacgagtccaggaacagccttgttctacaaaatggactagtctgacgacctaggacgacacggctgtacttattactgtcgaccgaagacggaacccggaggggggccgganccgacccggtacccccgtaagttcgngggggacccaacgggggaaccccggtccacccggttctacccgtacgacgtacccctacccgaacccgaaacggggcccctaacgttcccggttccccttcccccgtcggacccctacccccgttccaacccgaaacgacccgacccgaacccgttccgggacgggggacccaacggaccgggacccgggtccccgtggggcccttcggcccggttacggaccgaaacggttaccttaaccgtttcctaactaccgtacgtccgacgtcgacggccgggtcgtaacggaccgaaggccacgagtacgnn

SEQ ID NO: 313066 - DNA, 650 bp, Homo sapiens
  misc_feature: GZ8MTXP02GEB5A.52.53.E09.1.454.CMB.2.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (378)..(378): a, c, t, g, unknown or other
  misc_feature (378)..(378): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
tcagcgcagtacgacacgaccggtgctcgatttagagagagtgtgttgggtttgggggagctctggggagtctgcaccatggcttggaccccactcctcttcctcaccctcctcctccactgcacaggtctctctcccagcctgtgctgactcaatcgccctctgcctctgcctccctgggagcctcggtcaagctcacctgcactctgagcagtgggcactacacctagccatcgcatggcatnagtcngcagccaggagaacggccctcggtaacttgatggaggcttacaacgtagtgaagtcggcgaacgcccgaacacggtaccggaggggggaccccgttaacgtcccgtgaagtccggtcttccgtaccgngggccttccgggcgtaccgngggtaccgngacgaccgaccgtactaccacgtactacccgcctacgtccctacgtacgtccggaggaaacgggtagggtaacggtcgtacgttacgtacgtaccgtacggtaccggtacgtacggaccgtacgtacgtaacggttacggttcggtcgggtaacggtacggggtaacggtaaccgtaacgttaccggaaccgttaaccgtacggaacgtaccggtacccgaggtacccctaccggtacccccg

SEQ ID NO: 313067 - DNA, 684 bp, Homo sapiens
  misc_feature: GZ8MTXP02FN07M.52.53.E09.1.454.CMB.2.raw
  modified_base (205)..(205): a, c, t, g, unknown or other
  misc_feature (205)..(205): n is a, c, g, or t
  modified_base (683)..(683): a, c, t, g, unknown or other
  misc_feature (683)..(683): n is a, c, g, or t
tcagcgcagtacgacacgaccggtgctcgatttagagagagtgtgttgggtttggggggaggcttggtccagcctggtggttccctgagactctcctgtgcagcctctggattctccgtcagtagcaactacatgagctgggtccgccaggctccaggggaaggggctggagtgggtctcaagtcttttatgtcggtggtaccanatattatgctgactccgtgaagggccattcacatctcagagacgagtccaggaacagcctgttcttacaaatggacagtctgacgacctgacgacacggctgtctattacgtgtgcgagaacggaacccggaggggggcggagcgaccgtacccccgttaagtcggtcggggacccgaacggggtaccccgggtccaccgtctccctcacgccctcccgaacccgaaacgggcccctagttcccgggttcccttacccccgtggacccctaccccctcccgtacccgaaagaccgcctaacccgttcggtacgggggacccacgacgggacccgggcccgtgggggcctcgggacccgttcgggaaccgaaacgggtacccttacctttaccgtaacgtaaccggacgttccggacgttacgggaaccgggccggggtacggtaacgggaccgaaaaggggccgaacgtaagacggang

SEQ ID NO: 313068 - DNA, 650 bp, Homo sapiens
  misc_feature: GZ8MTXP02FG1PT.52.53.E09.1.454.CMB.2.raw
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (327)..(327): a, c, t, g, unknown or other
  misc_feature (327)..(327): n is a, c, g, or t
tcagcgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccgagggaaggggctggagtgggtctcaagtctttatgtcggtggtaccacatattatgctgactcgtgaagggcattcacatctccagagacgagtccaggaacngcctgttctanaaatggacagtctgagacctgacgacacggctgtctatactgtgcgagacgaacccgngggggcgacgcgaccgccccgtaatcgtcggggaccgacgggaacccgtgccgaccgtctccgtacacgccctaccgaaccgacgggcccagtccggtcccttcccccgtcggccctaccccgtccctaccgaaacgccgacctaccgtcggtcgggggacctaaccggcgggacccggccccggttacggggcccgttacggccccgttacgggacctaaaacggggtcccttaaaccgttcctaacgtacgaacgtcggaccgttacggaacggtccggggtaaccgtaggggaccgaaacgggtccgagtaaacgtggac

SEQ ID NO: 313069 - DNA, 642 bp, Homo sapiens
  misc_feature: GZ8MTXP02HB15G.52.53.E09.1.454.CMB.2.raw
  modified_base (413)..(413): a, c, t, g, unknown or other
  misc_feature (413)..(413): n is a, c, g, or t
tcagcgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagctgacacgccaggacggaacgggcccctacggtactgatcggaggtctacgaacaggtgagtggacacgaccgacgaggacgacgggggacgtacgtcccgtgactcgtctcgtccgacggtccgtccggcgtcggtgggtctgacgccgtactacctccaaccncttccgccacgtccctacgcgtcgtacggaacgggtaccgtaggggtacctaacgttacgttaaccgtggttaaccgagggtacggggttagggaaccgttaacgggtcggtaccgttaggggtttttcgggggacggttacggggacggggtaacggtaacccgttaagggttccgtaaccggtacgttaacggacgaaccgggacccaacggggtcccttccccggg

SEQ ID NO: 313070 - DNA, 496 bp, Homo sapiens
  misc_feature: GZ8MTXP01AQEOS.2.57.F02.1.454.CMB.2.raw
  modified_base (277)..(277): a, c, t, g, unknown or other
  misc_feature (277)..(277): n is a, c, g, or t
  modified_base (342)..(342): a, c, t, g, unknown or other
  misc_feature (342)..(342): n is a, c, g, or t
  modified_base (419)..(419): a, c, t, g, unknown or other
  misc_feature (419)..(419): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgtggtcactatttggcctggtatcagcataaaccagggaaanccccagaactcctgatctatgatgcctcagtctggaggtgggtcccccatcaaggttcagcggcngtgatctgggacagaattcactctcacatcaacagcctgcagcctgatgattttgactaacttattactgacccaanagtatggtaggtaattatccgtggcgttcggccgaggggaccaagggttggaaatcaaacgaactgtggctgcaacc

SEQ ID NO: 313071 - DNA, 567 bp, Homo sapiens
  misc_feature: GZ8MTXP01BE4D1.2.57.F02.1.454.CMB.2.raw
  modified_base (279)..(279): a, c, t, g, unknown or other
  misc_feature (279)..(279): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcaataaaccagggaaacnccccaagaactcctagatctatgatcgcctcagtctggagggtgggtcccccatcgaaggttcaggcgggacaaggtagatcgtggggacagaaattcactctacaccatccaaacagcctgcagcctgatgtattttgactaacttatactgaccaatagtatggtaggtaaattgtccggtggggttccgttacgggcccgaaaggggggtaacccaaagggggttcgggaaaaacttaacgaaaaaccggtaacgttggtacgggcttaacgggccgtaaacccg

SEQ ID NO: 313072 - DNA, 500 bp, Homo sapiens
  misc_feature: GZ8MTXP01BJM4F.2.57.F02.1.454.CMB.2.raw
  modified_base (276)..(276): a, c, t, g, unknown or other
  misc_feature (276)..(276): n is a, c, g, or t
  modified_base (425)..(425): a, c, t, g, unknown or other
  misc_feature (425)..(425): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggcctggtatcagcataaaccagggaaacnccccagaactcctgatctatgatgcctcagtctggagggtgggtcccccatcaaggttcagcgggcaagtagatcgtgggacagaattcactctcaccatcaacagcctgcagcctgatgtattttgactaacttattactgacccaanagtatggtagtaattgtccggtggcgttcggcgtaggggaccaagggttgaaatcgaaacgcgtgtggctgcaac

SEQ ID NO: 313073 - DNA, 560 bp, Homo sapiens
  misc_feature: GZ8MTXP01CLPNG.2.57.F02.1.454.CMB.2.raw
  modified_base (278)..(278): a, c, t, g, unknown or other
  misc_feature (278)..(278): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactatttggcctggtatcagcaataaaccaggaaanccccaagaactcctgatctatgatgcctcagtcgtggagggtcggggtccccccatcgaaggttcaggcggcaaggtagatcgtgggacagattcactctcaaccataccaacagcctgcagcctgatgtattttgactaaattattaactgaccctaaatagttatgggttagtaaactttagtcccggttaggggttccgtttcgggcccgaaagggggtacccaaaggggttcggaaaacttcgaaaacggaacgttggtacggctcgaacgtaacccg

SEQ ID NO: 313074 - DNA, 547 bp, Homo sapiens
  misc_feature: GZ8MTXP01CG3KG.2.57.F02.1.454.CMB.2.raw
  modified_base (347)..(347): a, c, t, g, unknown or other
  misc_feature (347)..(347): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagagtcaccatcacttgccgggcagtgagagtgttggtcactattggcctggtatcagcaataaaccagggaaagccccagaactcctgatctatgatgcctcagtctggagggtgggtcccccatcaagggttcagcggganaagtagatcgaggacagtaatcactctacacatacaacgacgtcctgacacgtcgtagtagttagttagtttacgtacttaacttaacttactacgtactaactagtagtaggtagtagttagtcggtcggttcggtcggacggacgggacggaaggttaggttaacgtaacgaaacgtaacgtagtcgcgtcgcgtaac

SEQ ID NO: 313075 - DNA, 541 bp, Homo sapiens
  misc_feature: GZ8MTXP01CAJOC.2.57.F02.1.454.CMB.2.raw
  modified_base (275)..(275): a, c, t, g, unknown or other
  misc_feature (275)..(275): n is a, c, g, or t
  modified_base (437)..(437): a, c, t, g, unknown or other
  misc_feature (437)..(437): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctccaccctgtctgcatcagtaggagacagagtcaccatcacttgccggcagtgagagtgtggtcactattggcctggtatcagcaataaaccagggaaacnccccagaactcctgatctatgatgcctcagtcgtgggagggtcggggtccccccatcgaaagggttcaaggcggacaagtagatcgtgggaacagtaaattcactctccaacatcaaacagtcctagacacgcctgattgtattttcgactaacttattacngaccaaagtgtatgggtagttaaattgtcccggtgggcgttcgggcgtaaggggaccaaagggttgaaaactcgaaaaccgtaagttggacgcgtgcgtaaccc

SEQ ID NO: 313076 - DNA, 533 bp, Homo sapiens
  misc_feature: GZ8MTXP01D8Z03.2.57.F02.1.454.CMB.2.raw
  modified_base (281)..(281): a, c, t, g, unknown or other
  misc_feature (281)..(281): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcaataaaccgagggaaacnccccaagaacctcctgatctatgatgcctccagtcgtggagggtcgggtccccagtcgaaggttcagcggcaaggtagatcgtgggacagaattcactctacacatacaacacgcctgcagcctgatgtattttcgactaacttatactgaccaatagtatgggttagtaattgtccggtgggccgttcgggccgaaggggtaccttaaagggttgaaaatcgaaaacgtaacgtaggtggctcgctaaccg

SEQ ID NO: 313077 - DNA, 581 bp, Homo sapiens
  misc_feature: GZ8MTXP01EJ5BG.2.57.F02.1.454.CMB.2.raw
  modified_base (235)..(235): a, c, t, g, unknown or other
  misc_feature (235)..(235): n is a, c, g, or t
  modified_base (283)..(283): a, c, t, g, unknown or other
  misc_feature (283)..(283): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtaggagacagagtcaccatcacttgccgggcagtgagngtgtggtcacttattggcctggtatcagacaataaaccgagggaaacnccccaagaactcctgatctatgatcgcctcgagtcgtgggagggtcgggtcccccagtcgtaaggttcaggtacggacaaggtagatcgtagggacagtaacttcactctacaccatccgaaactcgcctagcagcctagattgtaattttcgacttaaactttatactgacctaaagtagtagtggttagttaattcggtccggttgggttccggttcgggaccggaaggggtaaacccgaaggggttacgaaaacgtaacgaaacgtaacgttcggcggttactaacgcctaaccg

SEQ ID NO: 313078 - DNA, 551 bp, Homo sapiens
  misc_feature: GZ8MTXP01DDSL9.2.57.F02.1.454.CMB.2.raw
  modified_base (278)..(278): a, c, t, g, unknown or other
  misc_feature (278)..(278): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccacctgtctccatcagtaggagacagagtcaccatcacttgccggcagtgagagtgttggcactattggcctggtatcagcaataaaccgagggaaacnccccaagaacctcctagatctatgatcgctccagtcgtggaggtgggtccatcgaagttcagcggacagtgatcgtagggacagaattcaactctacaccatacgaacagccctagcacgccttgaattgaattttcggacttaaacttnttaacngaccctaaagagttataggtaggtaaattcgtccggttgggtcgttacgggaccgttaagggggtaaccaaaggggttagaaattacgaaaacgtatggtgacttcgaacaacctaa

SEQ ID NO: 313079 - DNA, 525 bp, Homo sapiens
  misc_feature: GZ8MTXP01D7PDM.2.57.F02.1.454.CMB.2.raw
  modified_base (234)..(234): a, c, t, g, unknown or other
  misc_feature (234)..(234): n is a, c, g, or t
  modified_base (277)..(277): a, c, t, g, unknown or other
  misc_feature (277)..(277): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagagtcaccatcacttgccgggcagtgagngtgtgtcactattggctggtatcagcaataaaccagggaaacnccccaagaactcctgatctatgatcgcctcagtcgtgggagggtcgggtcccccagtcgaaggttcaggcggcaaggtagatcgtgggacagaattcactctcaccatcaacagcctgcagcctgaattgtattttgacttaaacttattactcgaccaatagtatggttagtaattagtcggtgggttcgttcggccgaaggggacaagggttgaaataacgaaaacgaactggtggactgctaacg

SEQ ID NO: 313080 - DNA, 525 bp, Homo sapiens
  misc_feature: GZ8MTXP01BSXU7.2.57.F02.1.454.CMB.2.raw
  modified_base (277)..(277): a, c, t, g, unknown or other
  misc_feature (277)..(277): n is a, c, g, or t
  modified_base (515)..(515): a, c, t, g, unknown or other
  misc_feature (515)..(515): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcaataaaccagggaaanccccagaactcctgatctatgatgcctccagtctggaggggtcggggtccccccagtcgaaggttcaggcgggcaaggtagatcgtggggacagaattcactctcaccatacaacagcctgcacgcctgattgtatttttgactaacttattactgacccaagtagtatgggttagttaaattgtccggtgggttcgttccgggcgacgggggaccaagggttgaaatcaacgaatgnggctgctaac

SEQ ID NO: 313081 - DNA, 515 bp, Homo sapiens
  misc_feature: GZ8MTXP01BYZ79.2.57.F02.1.454.CMB.2.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
  modified_base (502)..(502): a, c, t, g, unknown or other
  misc_feature (502)..(502): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtaggagacagagtcaccatcacttgccgggcagtgagagtgtgtcatattgcngtatnagcataaacaggaacnccccagaactcctgatctatgatcgccctcagtcgtgggagggtcggggtccccccagtcgaaggttcaggcggcaagtagatcgtaggggacaagacttcactctaccacatacaacacgcctgcagcctgatgtattttcgactaacttatactgaccaatagttatggtagttaattgtcggtggcgttcggcgtaggggacaagggttgaaactcgaaacgtaacgtgnggactcgctaacc

SEQ ID NO: 313082 - DNA, 512 bp, Homo sapiens
  misc_feature: GZ8MTXP01DCZEH.2.57.F02.1.454.CMB.2.raw
  modified_base (277)..(277): a, c, t, g, unknown or other
  misc_feature (277)..(277): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggcctggtatcagcataaaccagggaaacnccccagaactcctgatctatgatgcctcagtctggagggtcgggtcccccatcgaaggttcagcggcaagtagatcgtagggacagtaattcactctcacatcaaacagcctgcagcctgatgtattttgctaactttatacgtgaccaagtagtatggtagtaattcgtcggtgggcgttcgggcgaaggggacaagggttggaaatcgaaaacgtctggacggctcgctaacc

SEQ ID NO: 313083 - DNA, 509 bp, Homo sapiens
  misc_feature: GZ8MTXP01EG6NB.2.57.F02.1.454.CMB.2.raw
  modified_base (278)..(278): a, c, t, g, unknown or other
  misc_feature (278)..(278): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
  modified_base (391)..(391): a, c, t, g, unknown or other
  misc_feature (391)..(391): n is a, c, g, or t
  modified_base (422)..(422): a, c, t, g, unknown or other
  misc_feature (422)..(422): n is a, c, g, or t
  modified_base (433)..(433): a, c, t, g, unknown or other
  misc_feature (433)..(433): n is a, c, g, or t
  modified_base (498)..(498): a, c, t, g, unknown or other
  misc_feature (498)..(498): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactatttggcctggtatcagcaataaaccagggaaanccccaagaacctcctgatctaatgatgcctccagtcgtggaggggtcggggtcccccatcgaaggttcagcgggcnggtagatcgnggggacagaattcactctcacatcaanagcctgcagctgatgattttgctaaactttntactgaccaanagttatggtagtaattgtccggtggcgttcggcgaggggacaagggttgaaatcgaaagaactgnggactgcaacg

SEQ ID NO: 313084 - DNA, 510 bp, Homo sapiens
  misc_feature: GZ8MTXP01AOAP2.2.57.F02.1.454.CMB.2.raw
  modified_base (391)..(391): a, c, t, g, unknown or other
  misc_feature (391)..(391): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtcctgcatcagtaggagacagagtcaccatcacttgccgggcagtgagagtgttggtcactatttggcctggtatcagcataaaccagggaaacgccccagaactcctgatctatgatgcctccagtcgtgggagggtcggggtcccccagtcaaggttcaggcggcaagtagatcgtgggacagtaattcactctcaccatacaanacgcctagcagcctgatgattttgactaattattactgaccaanagtntggtgtaattntcgtggcgttcggcgagggaccaggttcggaataacgaaacgtaactggtggctgcaacc

SEQ ID NO: 313085 - DNA, 534 bp, Homo sapiens
  misc_feature: GZ8MTXP01EF9U8.2.57.F02.1.454.CMB.2.raw
  modified_base (278)..(278): a, c, t, g, unknown or other
  misc_feature (278)..(278): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggctggtatcagcaataaaccagggaaacnccccaagaactcctgatctatgatcgcctccagttctgggagggtcgggtcccccagtcgaaggttcaggcggacaaggtagagtcgtaggggacagaattcactctacacatacaacacgctgcacgctgatgtattttgactaactttatactgacctaaatagtatgggttagttaattgtccggtgggttcggttcggccgagggggtaaccagggttacgaagtaacgaaagtaacgtagtggctgctaac

SEQ ID NO: 313086 - DNA, 492 bp, Homo sapiens
  misc_feature: GZ8MTXP01D9NYC.2.57.F02.1.454.CMB.2.raw
  modified_base (245)..(245): a, c, t, g, unknown or other
  misc_feature (245)..(245): n is a, c, g, or t
  modified_base (351)..(351): a, c, t, g, unknown or other
  misc_feature (351)..(351): n is a, c, g, or t
  modified_base (394)..(394): a, c, t, g, unknown or other
  misc_feature (394)..(394): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (468)..(468): a, c, t, g, unknown or other
  misc_feature (468)..(468): n is a, c, g, or t
  modified_base (482)..(482): a, c, t, g, unknown or other
  misc_feature (482)..(482): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagagtcaccatcacttgccgggcagtgagagtgtgtcactnttggctggtatcagcaataaacgagggaaacccccaagactcagatctatgatcgcctcgagttcgtgggagggtcgggtcccccagtacgaaggttcaggcgganaaggtagagtcgtagggacagtaacttcactcacacatacaanacgctagcagctgatgtatttgactaacttntacnacatgtgtgtatatgtcgtggcgtcgcgagggacagganaataagaagtgtgngctcgctaac

SEQ ID NO: 313087 - DNA, 574 bp, Homo sapiens
  misc_feature: GZ8MTXP01ESNKD.2.57.F02.1.454.CMB.2.raw
  modified_base (282)..(282): a, c, t, g, unknown or other
  misc_feature (282)..(282): n is a, c, g, or t
  modified_base (363)..(363): a, c, t, g, unknown or other
  misc_feature (363)..(363): n is a, c, g, or t
  modified_base (562)..(562): a, c, t, g, unknown or other
  misc_feature (562)..(562): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagagtcaccatcacttgccgggcagtgagagtgttggtcacttattggctggtatcagacaataaaccgagggaaacnccccaagaacctcctgatctatgatcgcctcagttcgtggggagggtcggggtccccccagtcgaaggttcaggcgggacnggtagagtcgtaggggaacagtacttcactctacacatacaacacgcctgcacgcctagattgtatttttacgacttaaactttattactcgacctaagtagttagtgggttagttaacttagtccggttggggttccgttcgggaccgtaaggggaaccgaaggggttacgaaacgtaacgaaaacgtaagttcgggngactcgctaacg

SEQ ID NO: 313088 - DNA, 607 bp, Homo sapiens
  misc_feature: GZ8MTXP01DK0BG.2.57.F02.1.454.CMB.2.raw
  modified_base (201)..(201): a, c, t, g, unknown or other
  misc_feature (201)..(201): n is a, c, g, or t
  modified_base (278)..(278): a, c, t, g, unknown or other
  misc_feature (278)..(278): n is a, c, g, or t
  modified_base (401)..(401): a, c, t, g, unknown or other
  misc_feature (401)..(401): n is a, c, g, or t
  modified_base (448)..(448): a, c, t, g, unknown or other
  misc_feature (448)..(448): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccggcagtgagagtgttggtcacttattggctggtatcagcaataaaccgaggaaacnccccagaactcctgatctatgatcgcctcagtcgtgggagggtcgggtccccccagtcgaaggttcaggcggcaaggtagatcgtaggggaacagtaattcacttctaccaccataccaaacncgacctgaccagcctagattgttattttcgacttaaactttattacncgaccctaaagtagttagttagggttagttaaactttcggtcccgggtggggttccggtttaccgggaccggtaaacgggggaaccgttaaaggggttacggaaaacgttaaccgaaaaacgggtaacgttggggtacggaccttcggaacctaacccg

SEQ ID NO: 313089 - DNA, 484 bp, Homo sapiens
  misc_feature: GZ8MTXP01DVPYX.2.57.F02.1.454.CMB.2.raw
  modified_base (274)..(274): a, c, t, g, unknown or other
  misc_feature (274)..(274): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcacatcacttgccgggcagtgagagtgtggtcactattggctggtatcagcaataaaccaggaaanccccagaactctgatctatgatgcctcagtctggagggtgggtcccccatcgaaggttcagcggcaaggtagatcgtgggacagaattcactctacaccgatacaaactacgcctgcacgcctgatgtattttgactaattatatgaccatagtatggtagtatgtcgtggcgttcgcgagggacaggngaancaaagctgngntgcaac

SEQ ID NO: 313090 - DNA, 574 bp, Homo sapiens
  misc_feature: GZ8MTXP01ECBQJ.2.57.F02.1.454.CMB.2.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
  modified_base (404)..(404): a, c, t, g, unknown or other
  misc_feature (404)..(404): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtagganacagagtcaccatcacttgccggcagtgagngtgtgtcatnttggctgtatcagacaataaaccaggaacnccccaagaactctgatctatgatcgcctcgagttcgtgggacggggtcgggtcccccagtcgaaggttcaggcggactaaggtagacttcggtaggggaactaagtaacttcacttcaccacatacaaacncgcctgacagcctagattcgtattttcgacttaactttactactcgaacctaagtagttagttgggtagtttaacttcggtccgggttgggttccggttacgggaccgtaagggggtaaccaagggttacggaaactaacgaaaacgtcgttggcggttactcgcgtaac

SEQ ID NO: 313091 - DNA, 554 bp, Homo sapiens
  misc_feature: GZ8MTXP01B4LOV.2.57.F02.1.454.CMB.2.raw
  modified_base (197)..(197): a, c, t, g, unknown or other
  misc_feature (197)..(197): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgagacccagatgaccagtctcctccaccctgtctgcatcagtaganacagagtcaccatcacttgccgggcagtgagagtgtggtcactattgctggtatcagcaataaaccagggaaacgccccaagaactcctgatctatgatgcctcagtctgggagggtcgggtcccccagtcaaggttcaggcgcaagtagatcgtgggacagaattcactctacaccatacaaacacgcctagcagctgatgtatttgtactaacttaacttaactacgtacctaacctaacgtagttaggttaggttaagttaagttccggtcgggttcggttccggttccggacgggtaccggaacggttaggttaaagtaacgaaacgaacgtagtaggttcgtcgcgtaaccg

SEQ ID NO: 313092 - DNA, 613 bp, Homo sapiens
  misc_feature: GZ8MTXP01A6MFS.2.57.F02.1.454.CMB.2.raw
  modified_base (271)..(271): a, c, t, g, unknown or other
  misc_feature (271)..(271): n is a, c, g, or t
  modified_base (347)..(347): a, c, t, g, unknown or other
  misc_feature (347)..(347): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtgtcatattgctggatcagcataaaccaggaaacnccccagaactctgatctatgatcgcctcgagtcgtgggaggggtcggggtcccccagtcgaaaggttcaggccggnaagtagatcgtggggaacagtaacttcactctacacatacaacacgctgaccagcctagatttagtatttttacgacttaaactttacttacgtcgaccctaaagtaaggttacgttggggttaaggttaaactttcggttcccgggttagggggttcccggttttacgggacccgggtaaacggggtaacccgttaaaggggttacggttaaaattaaccggaaaaacggtaaccgttgggtacggaccgttcgaaccgtaaccg

SEQ ID NO: 313093 - DNA, 536 bp, Homo sapiens
  misc_feature: GZ8MTXP01DA23C.2.57.F02.1.454.CMB.2.raw
  modified_base (231)..(231): a, c, t, g, unknown or other
  misc_feature (231)..(231): n is a, c, g, or t
  modified_base (275)..(275): a, c, t, g, unknown or other
  misc_feature (275)..(275): n is a, c, g, or t
  modified_base (353)..(353): a, c, t, g, unknown or other
  misc_feature (353)..(353): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
  modified_base (502)..(502): a, c, t, g, unknown or other
  misc_feature (502)..(502): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtaggagacagagtcacatcacttgccgggcagtgagngtgtggtcatattgctggtatcagacaataaaccgagggaaacnccccaagaacctcctagatctatgatcgcctcgagtcgtgggaggggtcgggtcccccagtcgaaggttcaggccggnaagtagatcgtagggacagattcactcncacatacaaacngcctgcagctagattgtatttgacttaaacttatactcgacctaagtagtgtggtagttaaacttcgtccgggtggttcggttcggacggaacggggtaacaagggttnaaacgtaacaaacgtaagtggcggctcgctaacg

SEQ ID NO: 313094 - DNA, 511 bp, Homo sapiens
  misc_feature: GZ8MTXP01ANWZ5.2.57.F02.1.454.CMB.2.raw
  modified_base (279)..(279): a, c, t, g, unknown or other
  misc_feature (279)..(279): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcaataaaccagggaaacnccccagaactcctgatctatgatgcctccagtctgggagggtcggggtcccccagtcgaaggttcaggcggcaagtagatcgtggggacagaattcactctcacatcaacagcctgcagcctgattgtattttgactaacttatactgaccctaagtagtatggtagtaattgtccgtgggcgttcggcgaaggggaccagggttgaaatcgaaagaactggtggctgcaac

SEQ ID NO: 313095 - DNA, 522 bp, Homo sapiens
  misc_feature: GZ8MTXP01AH10Z.2.57.F02.1.454.CMB.2.raw
  modified_base (201)..(201): a, c, t, g, unknown or other
  misc_feature (201)..(201): n is a, c, g, or t
  modified_base (278)..(278): a, c, t, g, unknown or other
  misc_feature (278)..(278): n is a, c, g, or t
  modified_base (428)..(428): a, c, t, g, unknown or other
  misc_feature (428)..(428): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgttggtcactattggcctggtatcagcataaaccagggaaacnccccagaactcctgatctatgatgcccgtccagtctgggaggggtcggggtccccccagtcaaggttcagcgggcaaggtagatcgtggggacagaattcactctcacatcaacagcctgcagcctgatgatttgactaacttattaacngaccaatagtatggtagtaattgtccggtgggttcgttcgggcgaagggggaccaagggttgaaataacgaaacgaacgttggagctgctaacc

SEQ ID NO: 313096 - DNA, 518 bp, Homo sapiens
  misc_feature: GZ8MTXP01DMZGE.2.57.F02.1.454.CMB.2.raw
  modified_base (275)..(275): a, c, t, g, unknown or other
  misc_feature (275)..(275): n is a, c, g, or t
  modified_base (347)..(347): a, c, t, g, unknown or other
  misc_feature (347)..(347): n is a, c, g, or t
  modified_base (423)..(423): a, c, t, g, unknown or other
  misc_feature (423)..(423): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggctggtatcagcataaaccaggaaanccccagaactcctgatctatgatgcctccagtcgtggagggtcggggtcccccatcgaaggttcaggcggcngtagatcgtgggacagaattcactctcacatcaacagcctgacagcctgatgtattttcgctaaactttattactnaccaatagtagtggtagtattagtccgtggggttcgttcggcgaggggtaccaagggttcgaaaattcaaaaacgtctaggtggactgcgtaacc

SEQ ID NO: 313097 - DNA, 554 bp, Homo sapiens
  misc_feature: GZ8MTXP01CUSQ4.2.57.F02.1.454.CMB.2.raw
  modified_base (284)..(284): a, c, t, g, unknown or other
  misc_feature (284)..(284): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcacttatttggcctggtatcagacaataaaaccgagggaaacnccccaagaacctcctagatctatgatcgcctcgagtcgtggggagggtcgggtcccccagtcgaaggttcaggcggcaagtagatcgtagggacagtaacttcactctacacatacacagcctgcagctagtattgtatttgaccttaacttattcagaccaagtagttagtggtagttaacttcgtcggtggttcggttcgacggtaaacggggtccaaaggggttcgaaactaaccggaaaacgtcgtggtcggacttcggcctaacg

SEQ ID NO: 313098 - DNA, 564 bp, Homo sapiens
  misc_feature: GZ8MTXP01BSA6E.2.57.F02.1.454.CMB.2.raw
  modified_base (277)..(277): a, c, t, g, unknown or other
  misc_feature (277)..(277): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggctggtatcagcaataaaccagggaaacnccccaagaactcctgatctatgatgcctccagtcgtgggagggtcggggtcccccagtcgaaggttcagcggcaagtagatcgtagggacagtatcactctcacatcaacagcctgcagcctgactgtattttcgacttaaacttattactgaccctaatagttatgggtagtaaattcgtcccggttggggttccggtttacggccggtaagggggtaacccttaaggggttcgaaaacgttaacgaaaacggtaacgtggttacgggacttcggaacctaacccg

SEQ ID NO: 313099 - DNA, 529 bp, Homo sapiens
  misc_feature: GZ8MTXP01C9XIH.2.57.F02.1.454.CMB.2.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
  modified_base (355)..(355): a, c, t, g, unknown or other
  misc_feature (355)..(355): n is a, c, g, or t
  modified_base (436)..(436): a, c, t, g, unknown or other
  misc_feature (436)..(436): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagatcacatcacttgccggcagtgagngtgtgcatattgcngtatcagcataaaccgaggaaacnccccagaacctctagatctatgatcgcctcagtcgtggggagggtcgggtcccccagtcgaaggttcaggcggcaagtagagtcgngggacagtaattcactctacaccatacaacacgcctgcagcctagatgtattttgactaaacttatactgaccaagtagtntggtagttaattacgtcggtgggcgttacgcggaacgggaacgaaagggttgaaacgtaacgaaaacgtaacgtggtacggactcgaactaac

SEQ ID NO: 313100 - DNA, 556 bp, Homo sapiens
  misc_feature: GZ8MTXP01EGG9C.2.57.F02.1.454.CMB.2.raw
  modified_base (276)..(276): a, c, t, g, unknown or other
  misc_feature (276)..(276): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggctggtatcagcataaaccagggaaacnccccaagaacctcctgatctatgatcgcctcagtctgggagggtcggtcccccatcgaaggttcaggcggcaagtagagtcgtggggaacagtaattcactctcacatcaacagcctgcagcctgatcgtattttgacttaaactttataactcgaccctaatagttattgggttaggttaattacgtccgggttaggggttccgttacgggttccgaacgggggaaccaaggggttgaaaacgtccgtaaaacggaacgtcggtaggctcgccgtaacc

SEQ ID NO: 313101 - DNA, 645 bp, Homo sapiens
  misc_feature: GZ8MTXP01DOYUQ.2.57.F02.1.454.CMB.2.raw
  modified_base (276)..(276): a, c, t, g, unknown or other
  misc_feature (276)..(276): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtgtcatattggctggtatcagcaataaaccgagggaaacnccccaagaactcctgactctatgatcgccctcagtcgtgggagggtcgggtacccccagtcgaaggttcaggcggcaaggtagatcgtagggacagaacttcactctacaaccataccaaacacgccctagccacgtccctaggtattacggttaagtttttcgaacctttaaactttagtttaccacgaaccctaaagttaggttaagttaggggttacggttaaactttcgggtccgggttacgggggttcccggtttaaccggggaccgggtaaacgggggtaacccgttaaaaggggttacggttaaaaacgttaaccgaaaaaacgggtcgttggggtacgggacttaaccggccgtaaacccg

SEQ ID NO: 313102 - DNA, 531 bp, Homo sapiens
  misc_feature: GZ8MTXP01E5LXT.2.57.F02.1.454.CMB.2.raw
  modified_base (232)..(232): a, c, t, g, unknown or other
  misc_feature (232)..(232): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
tcagacgctcgacacacgaccggtgctcgatttagctcgatatagttgggtttggggcaggcgtcagactcagtcaggacacagcatggacatgaaggtccccgctcagctcctggggctcctgctgctctggctcccaggtgccaaatgtgacacccagatgacccagtcctccctcccaccctgtctgcatcagtagagacagagtcaccatcacttgccggcagtgagngtgtgcactattgctgtatcagcaagtaaccgaggaacncccagactcngatctatgatcgctcgagtcgtgggaggtcgtccccagtcgagtcagtcganaagtantcgaggactagtactcactcaccacactacactacgctagactgtctagtacttagttacgttacacttaacgttacacgtacactagtgtagtcgttaagtcgtcggtcgggtcgttacggtacgacgggaacggtacgttaagttacgaacctaacgacgtaacgttgggcttacaaccgttcgtaaccg

SEQ ID NO: 313103 - DNA, 560 bp, Homo sapiens
  misc_feature: GZ8MTXP01CUH5S.2.57.F02.1.454.CMB.2.raw
  modified_base (201)..(201): a, c, t, g, unknown or other
  misc_feature (201)..(201): n is a, c, g, or t
  modified_base (280)..(280): a, c, t, g, unknown or other
  misc_feature (280)..(280): n is a, c, g, or t
  modified_base (406)..(406): a, c, t, g, unknown or other
  misc_feature (406)..(406): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagatcaccatcacttgccgggcagtgagagtgttggtcactattggcctggtatcagacaataaaccgagggaaacnccccaagaactcctgatctatgatcgcctcagtcgtgggagggtcgggtacccccagtacgaaggttcaggcggacaagtagatcgtagggaacagtaacttcactctacacatacaacacgcctncagcctgattagtattttcgacttaactttacttactacgaccaataagtagttggtagttaattacgtccgggttgggccggtttcggaccggtaaggggtaccgaaagggttgaaagtaacgaaaacgtaacgttggtcgactcgcgtaacc

SEQ ID NO: 313104 - DNA, 577 bp, Homo sapiens
  misc_feature: GZ8MTXP01EQPR1.2.57.F02.1.454.CMB.2.raw
  modified_base (272)..(272): a, c, t, g, unknown or other
  misc_feature (272)..(272): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcatattggctgtatcagcataaaccaggaacncccagactctgatctatgatcgcctcagtcgtgggagggtcgggtcccccagtcgaaggttcaggtcggacaaggtagatcgtagggacagacttcactctacacatacaacacgcctgctacgcctagaacttgtattttcgactaaactttatacctagaccctaagtaagttgtaggttaggttaaacttcggttaaccgggttggggttcggtttaccgggacccggtaagggggtaacccgaaggggttacggaaacttaaccggaaaacgtaacgtggtacggcgtaacgccgtaaccg

SEQ ID NO: 313105 - DNA, 508 bp, Homo sapiens
  misc_feature: GZ8MTXP01ASVX4.2.57.F02.1.454.CMB.2.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
  modified_base (348)..(348): a, c, t, g, unknown or other
  misc_feature (348)..(348): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgttggtcactattggcctggtatcagcaataaaccagggaaacnccccagaactcctgatctatgatgcctccagtcgtggagggtgggtcccccagtcaaggttcagcggcngtagatcgtgggacagaattcactctcaccatcaacagcctgcagcctgatgattttgactaactttatactgccaatagtatggtagtaaattgtccggtgggcgttcggccgaaggggtaccaagggttgaaatcaaagaactggtcggactgcaacc

SEQ ID NO: 313106 - DNA, 578 bp, Homo sapiens
  misc_feature: GZ8MTXP01BXYO6.2.57.F02.1.454.CMB.2.raw
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggctggtatcagcaataaaccgagggaaacgccccaagaacctcctgatctatgatcgcctccagtcgtgggacggggtcggggtcccccagtcgaaggttccaggcggctaaggtagagtcgtaggggactagacttcactctacaccatacaaacacgacctgaccaggtcctgacttgtattttcgactaactttatacctgacctaagtagttagtggttaggttaaattgtcccgggtggggttaccgttcgggacccgtaagggggacccgaaaggggttgaaaacgttaacgaaaacggtcgttagggcggctaagccgtaacg

SEQ ID NO: 313107 - DNA, 544 bp, Homo sapiens
  misc_feature: GZ8MTXP01ETOHI.2.57.F02.1.454.CMB.2.raw
  modified_base (283)..(283): a, c, t, g, unknown or other
  misc_feature (283)..(283): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagagacagagtcacatcacttgccgggcagtgagagtgttggtcacttagtttggcctggtatcagacaataaaaccgagggaaacnccccaagaacctcctagatctatgatcgcctcagtcgtggggagggtcgggtcccccagtcgaaggttcaggtcggacaagtagagtcgtgggaacagtaattcacttcacacatacaacacgcctgcagcctgatgtatttgactaattatactgacctaagtagttagtggttagttaacttgtcggttggggttcggttcgggacgagggggaacaagggttcgaaactaacgaaacgaactggtcgcgttcgctaac

SEQ ID NO: 313108 - DNA, 551 bp, Homo sapiens
  misc_feature: GZ8MTXP01ASX9D.2.57.F02.1.454.CMB.2.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgtggtcactattggcctggtatcagcaataaaccgagggaaacnccccaagaacctcctgatctatgatcgcctcagtcgtgggagggtcgggtcccccagtcgaaggttcaggcgcaagtagatcgtagggacagtattcactctcacntacanacgcctgcagcctgatgtatttgactaacttatactcgaccaacgtagtagtgggtagttaaacttcgtcccgggtagggttccggttacggccggtaaaggggacccttaaggggttagaaactaacgaaaacgtaacgtggtacggactcgcctaaccg

SEQ ID NO: 313109 - DNA, 558 bp, Homo sapiens
  misc_feature: GZ8MTXP01EOPWL.2.57.F02.1.454.CMB.2.raw
  modified_base (277)..(277): a, c, t, g, unknown or other
  misc_feature (277)..(277): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggctggtatcagcaataaaccgaggaaacnccccagaactcctgatctatgatcgcctcagtcgtgggacgggtcggggtcccccagtacgaaggttcaggcgcaagtagatcgtgggacagattcactctacactatacaacgacgcctagcagcctagatgtattttgacttaaacttatactgacctaagtagttagtggtagttaattgtccgggtgggaccgttcgggacgaagggggtaaccaaggggttacgttaaaagtaaccgtaaaacggtaacttgggtacgttacttcggccgtaaccg

SEQ ID NO: 313110 - DNA, 604 bp, Homo sapiens
  misc_feature: GZ8MTXP01DVLTL.2.57.F02.1.454.CMB.2.raw
  modified_base (200)..(200): a, c, t, g, unknown or other
  misc_feature (200)..(200): n is a, c, g, or t
  modified_base (274)..(274): a, c, t, g, unknown or other
  misc_feature (274)..(274): n is a, c, g, or t
  modified_base (296)..(296): a, c, t, g, unknown or other
  misc_feature (296)..(296): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaganacagagtcaccatcacttgccgggcagtgagagtgtgcactattgctgtatcagacaataaaccgagggaaacnccccaagaacctcctgatctangatcgcctcagtcgtgggagggtcgggtccccccagtacgaaaggttcacggcgactaagtagagttccgaggggaactagtaacttcacttcacaccataccaacacgcctgacagcctgatcgtatttcgactaaactttatacgtacgaccctaaagtaggttaatggggtttagttaaaactttcggtcccgggttgggggttcccgtttacgggaaccccggaaagggggtaacccttaaacggggttagttaaaaccgttaacgaaaaacgtaacgtgggtggcccttaaggaacctaaccg

SEQ ID NO: 313111 - DNA, 556 bp, Homo sapiens
  misc_feature: GZ8MTXP01C8HY1.2.57.F02.1.454.CMB.2.raw
  modified_base (272)..(272): a, c, t, g, unknown or other
  misc_feature (272)..(272): n is a, c, g, or t
  modified_base (338)..(338): a, c, t, g, unknown or other
  misc_feature (338)..(338): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtaggagacagagtcaccatcacttgccgggcagtgagagtgtggtcactattggctggtatcagcataaacaggaaanccccagaactcctgatctatgatgcctcagtctggagggtcgggtccccatcaaggttcagcggcngtagatctgggacagaatcactctcacatcaacagcctgcagcctgatgattttgactaactttattactcgaccaactagttagttaggttaggttaaatttacgttccggttggggttccggtttaccggggccgtaaagggggtacccgttaaaagggttgggaaaaacgttaacgaaaaacgtaaccgttaggtggttactcggccgtaacccg

SEQ ID NO: 313112 - DNA, 584 bp, Homo sapiens
  misc_feature: GZ8MTXP01D1WG9.2.57.F02.1.454.CMB.2.raw
  modified_base (271)..(271): a, c, t, g, unknown or other
  misc_feature (271)..(271): n is a, c, g, or t
  modified_base (344)..(344): a, c, t, g, unknown or other
  misc_feature (344)..(344): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgtggtcatattggctggatcagcataaaccaggaanccccagaactcctgatcatgatcgcctccagtcgtgggagggtcggggtcccccatcgaaggttcaggcggcngtagatcgtagggacagattcactctcacatcaacagcctgcagcctgatgtattttgctaaactttattacgtcgacctaaacgtaagttagtagggttaggttaaatttacgtcccgggtggggttccggttttaccgggaccggttaaacggggggaacccgttaaaagggggttggttaaaaaccgtaacggaaaaacccggtaagtttagggtcggaccgttcgaaccgtaaccc

SEQ ID NO: 313113 - DNA, 530 bp, Homo sapiens
  misc_feature: GZ8MTXP01EYDEV.2.57.F02.1.454.CMB.2.raw
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactatttggcctggtatcagcaataaaccagggaaacgccccagaactcctgatctatgatgcctcagtctgggagggtcgggtcccccatcgaaggttcaggcggcaaggtagatcgtgggacagaattcactctacacatacaacagcctgcagcctgatgtattttgactaacttattactgacctaatagttagtggttagtaaacttgtccgggttgggccgttcgggcgtagggggaaccaagggttgaaactcgaaacgtaacgtggtcgctcgctaaccg

SEQ ID NO: 313114 - DNA, 548 bp, Homo sapiens
  misc_feature: GZ8MTXP01ANP5V.2.57.F02.1.454.CMB.2.raw
  modified_base (274)..(274): a, c, t, g, unknown or other
  misc_feature (274)..(274): n is a, c, g, or t
  modified_base (345)..(345): a, c, t, g, unknown or other
  misc_feature (345)..(345): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggcctggtatcagcataaaccaggaaanccccagaactcctgatctatgatgcctccagtctgggaggtcggggtcccccagtcaaggttcaggcggcngtagagtcgtgggacagaattcactctacaccataccaacagcctgcagcctgattgattttgactaaacttattacctgaccaaacgtagttatgggttagtaattaggtccggtggggttccgtttacgggccgtaaggggggtaacccaaggggttcgaaactaacgaaacgtaacgtggtaggcgttcgaaccgtaacc

SEQ ID NO: 313115 - DNA, 577 bp, Homo sapiens
  misc_feature: GZ8MTXP01D77E1.2.57.F02.1.454.CMB.2.raw
  modified_base (276)..(276): a, c, t, g, unknown or other
  misc_feature (276)..(276): n is a, c, g, or t
  modified_base (446)..(446): a, c, t, g, unknown or other
  misc_feature (446)..(446): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtgtcactattggctggtatcagcaataaaccgaggaaacnccccagaactcctgatctatgatcgcctccagtcgtgggacgggtcgggtccccccagtacgaaggttcaggcgggacaaggtagacgttacgtagggaactagtaacttcactctacacatacaacacgcctgcagcctgattgtattttgaacttaaactttattacncgacctaaagtagttaagtgggttagttaaattcggtcgggtgggttcggttccggacggtaaacgggggaaccttaagggttacgaaaacgttccgaaaacggaacgttggacgggttctcggctaaccg

SEQ ID NO: 313116 - DNA, 532 bp, Homo sapiens
  misc_feature: GZ8MTXP01ACIRY.2.57.F02.1.454.CMB.2.raw
  modified_base (276)..(276): a, c, t, g, unknown or other
  misc_feature (276)..(276): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcacatcacttgccgggcagtgagagtgtggtcactattggctggtatcagcaataaaccagggaaacnccccagaacctcctgatctatgatgccctccagtcgtgggtagggtcggggtcccccagtcaaaggttcaggcggcaagtagactcgtaggggacagaaattccaacttctacaccataccaacacgcctgctagcctgatgtattttgactaacttatactgaccaatagtagtggtaggtaattgtcggtgggttcgtcggcgtaggggaaccttagggttagaaataacgaaagaacgtgtacggctgctaac

SEQ ID NO: 313117 - DNA, 553 bp, Homo sapiens
  misc_feature: GZ8MTXP01DVTOV.2.57.F02.1.454.CMB.2.raw
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagagacagagtcacatcacttgccgggcagtgagngtgtgtcactattggctggtancagcataaaccgaggaaacnccccaagaactcctgatctatgatgccctcagtcgtgggagggtcgggtcccccagtcgaaggttcaggcggacaaggtagatcgtaggggaacaggtaattcactctcaaccatacaaacagcctgccagcctgaattgtaattttcgacttaaactttattactgacctaaagtagttagtggtagttaaactttagtccgggttggggttcgttcggaccggtaaggggaaccgaagggttggaaaataaccgaaaacgaacgtggaggctcgcgaac

SEQ ID NO: 313118 - DNA, 523 bp, Homo sapiens
  misc_feature: GZ8MTXP01ECSV4.2.57.F02.1.454.CMB.2.raw
  modified_base (359)..(360): a, c, t, g, unknown or other
  misc_feature (359)..(360): n is a, c, g, or t
  modified_base (369)..(369): a, c, t, g, unknown or other
  misc_feature (369)..(369): n is a, c, g, or t
  modified_base (432)..(432): a, c, t, g, unknown or other
  misc_feature (432)..(432): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactatttggcctggtatcagacaataaacccgagggaaacgcccccaagaacctcctgatctatgatcgcctccgagtcgtgggaggggtcgggtcccccagtcgaaggttcagcggnngtagatcgngggactagattcactctacacatacaacagcctgcagcctgatgtattttgactaattatacncgaccaatagtatggtagtaattgtcggtggcgtcggcgtaaggggaacaagggttggaaatcgaaaacgtaacgtggtacggctgctaac

SEQ ID NO: 313119 - DNA, 616 bp, Homo sapiens
  misc_feature: GZ8MTXP01E106R.2.57.F02.1.454.CMB.2.raw
  modified_base (280)..(280): a, c, t, g, unknown or other
  misc_feature (280)..(280): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcaataaaccgagggaaacnccccaagaactcctgatctatgatcgcctccgagtcgtggggacgggtcggggtccccccagtacgaaggttcaggaccggacaaggtagagtcgtaggggaacaggtaacttcactcacaccatacaacacgcctgacacgcctgatgtattttgacttaactttacgtactcgacctaaagtagttagtagggttaggtaaactttcggtaacccgggttggggttacccggtttaccggggccggaaagggggtaacccgttaaaggggttaacggttaaaacgttaaccggaaaacggtaacgttgggtacggccttaacggaacctaaccg

SEQ ID NO: 313120 - DNA, 528 bp, Homo sapiens
  misc_feature: GZ8MTXP01ABY4E.2.57.F02.1.454.CMB.2.raw
  modified_base (275)..(275): a, c, t, g, unknown or other
  misc_feature (275)..(275): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcataaaccaggaanccccagaactctgatctatgatgcctccagtctggagggtgggtcccccatcaaggttcagcggcaagtagatcgtgggacagaattcactctcacatcaacagcctgcagcctgatgatttgctaactttattaactgaccaaacgagtatggtaggtaattagtccggtagggttcgttcgggaccgtagggggaacccaagggttggaaacttaacgaaaacgaaccgtaggtcggctcggcctaacccg

SEQ ID NO: 313121 - DNA, 575 bp, Homo sapiens
  misc_feature: GZ8MTXP01CVGGW.2.57.F02.1.454.CMB.2.raw
  modified_base (202)..(202): a, c, t, g, unknown or other
  misc_feature (202)..(202): n is a, c, g, or t
  modified_base (279)..(279): a, c, t, g, unknown or other
  misc_feature (279)..(279): n is a, c, g, or t
  modified_base (321)..(321): a, c, t, g, unknown or other
  misc_feature (321)..(321): n is a, c, g, or t
  modified_base (423)..(423): a, c, t, g, unknown or other
  misc_feature (423)..(423): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagatcacatcactgccgggcagtgagagtgttggtcacttattggctggtatcagacaataaaccgagggaaacnccccaagaactcctagactctatgactgcctcagtcgtgggngggtcgggtcccccagtcgaaggttcaggacggcaagtagatcgtagggacagtaacttcactctacacatacaacagcctagcagctagattgtagttttnacttaacttatacacgtaccaagtagttagtcgggtagtaaacgttgtccggtaggggttacggttcgggaccggtaaagggggtaccgttaaaggggttcgaaaacgttccgaaaaaacgggtcttggggaccgcgttcggaaccgtaacc

SEQ ID NO: 313122 - DNA, 537 bp, Homo sapiens
  misc_feature: GZ8MTXP01D0AAL.2.57.F02.1.454.CMB.2.raw
  modified_base (280)..(280): a, c, t, g, unknown or other
  misc_feature (280)..(280): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcaataaaccagggaaacnccccaagaacctcctgatctatgatcgcctcagttctgggagggtcggggtccccccagtcgaaagggttcaaggtcgggacaaggtagatccgtaggggacaggaattcactctacaccatacaaacacgcctgaccagcctgaattgtatttttgacttaaactttattactgaccaatagtatggttagtaattgtcgtgggcgttcggcgaaggggacaagggttggaaatcgaaagaactgagctcgctaac

SEQ ID NO: 313123 - DNA, 549 bp, Homo sapiens
  misc_feature: GZ8MTXP01DM7JK.2.57.F02.1.454.CMB.2.raw
  modified_base (279)..(279): a, c, t, g, unknown or other
  misc_feature (279)..(279): n is a, c, g, or t
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
  modified_base (390)..(390): a, c, t, g, unknown or other
  misc_feature (390)..(390): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtaggagacagagtcaccatcacttgccgggcagtgagagttgttggtcacttgttggctggtatcagcaataaaccgaggaaacnccccaagaacctcctagatctatgatgcctcgagttcgngggagggtcggtccccagtcgaaggtcaaggcgnaaggtagagtcgagggacagtacttcactcacacctanacaactacgcctagctcgcctgacttgttacttttgaacttaactttacttacgtcgaacctaagtatagtgggtagttaattgtcggtgggcgttcgggacgaaggggtacaaagggttcgaaaatccgaaaagtcgttaggcggactcgccgtaacg

SEQ ID NO: 313124 - DNA, 540 bp, Homo sapiens
  misc_feature: GZ8MTXP01B26YM.2.57.F02.1.454.CMB.2.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (277)..(277): a, c, t, g, unknown or other
  misc_feature (277)..(277): n is a, c, g, or t
  modified_base (317)..(317): a, c, t, g, unknown or other
  misc_feature (317)..(317): n is a, c, g, or t
  modified_base (351)..(351): a, c, t, g, unknown or other
  misc_feature (351)..(351): n is a, c, g, or t
  modified_base (390)..(390): a, c, t, g, unknown or other
  misc_feature (390)..(390): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcacatcacttgccgggcagtgagngtgtgtcactnttggctggtatcagcaataaaccgagggaaacnccccaagaacctcctagatctatgatcgccctcgagtcgnggggaggtcgggtcccccatcgaaggtcagcggnaaggtagatcgagggacagtaatcactcacacatacaanacgctgcagcctgtatgtatttgacttaacttatactgacctaagtagtatgggttagtaacttcgtcgggtgggttccgttcggccggaaggggtaaccaaggggttcgaaaacgtcgaaacgtaacgtagggtcgactaacggctaac

SEQ ID NO: 313125 - DNA, 568 bp, Homo sapiens
  misc_feature: GZ8MTXP01DBX1X.2.57.F02.1.454.CMB.2.raw
  modified_base (279)..(279): a, c, t, g, unknown or other
  misc_feature (279)..(279): n is a, c, g, or t
  modified_base (317)..(317): a, c, t, g, unknown or other
  misc_feature (317)..(317): n is a, c, g, or t
  modified_base (362)..(362): a, c, t, g, unknown or other
  misc_feature (362)..(362): n is a, c, g, or t
  modified_base (439)..(439): a, c, t, g, unknown or other
  misc_feature (439)..(439): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacaccagatgacccagtcctcctcccacctgtctgcatcagtaggagacagagtcaccatcactgccgggcagtgagtgtgttggtcactagttggctggtatcagacaagtaaaccgaggaaacnccccaagaactcctagatctatgatcgccctcagtcgnggggagggtcgggtacccccagtcgaaggtcagcgggacaaggtnagtcgtgggaacagtaacttcactctacaacatacaacacgcctagcagctagacttgtattttcgactaactttanactcgacctaatagttatggtagttaactcggtccggtagggttccgttacgggaccgtaaggggtaaccaaggggttacgaaaacgtaaccgaaaagaaccgttggacggttactcggaacctaaccg

SEQ ID NO: 313126 - DNA, 576 bp, Homo sapiens
  misc_feature: GZ8MTXP01AM25F.2.57.F02.1.454.CMB.2.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgttggtcactattggcctggtatcagcataaaccgagggaaacnccccagaactcctgatctatgatgcctccagtcgtgggagggtcggggtcccccagtcgaaggttcaggtcggcaagtagatcgtagggacagtaattcactctcaccatacaacagcctagcagcctagattcgtattttcgactaactttattactcgacctaaagtagtagttagggtagttaaattcgtcccggtggggttccgttcgggccgtaaacgggggacccgaaaggggttacggaaaacgtaaccgaaaaccggtaacgttggtcgggcttaacggccgtaacccg

SEQ ID NO: 313127 - DNA, 555 bp, Homo sapiens
  misc_feature: GZ8MTXP01EA1QX.2.57.F02.1.454.CMB.2.raw
  modified_base (190)..(190): a, c, t, g, unknown or other
  misc_feature (190)..(190): n is a, c, g, or t
  modified_base (202)..(202): a, c, t, g, unknown or other
  misc_feature (202)..(202): n is a, c, g, or t
  modified_base (279)..(279): a, c, t, g, unknown or other
  misc_feature (279)..(279): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgaccccagtctcctccccaccctgtctncatcagtagganacagacgtcaccatccacttgccgggcagtgagagtgtggtcactattggctggtatcagcaataaaccaggaaacnccccaagaactccagatctatgatcgcctcgagtcgtggggacgggtcggggtacccccagtcgaaaggttcgagccgggcaagttagatcgtagggccaaggtacttcactctccaacntaccaagacnctncacgtcctagtatagttatttcgaacttataactttacgtcgaccctaagattagtggtagttaattactcgggtaggttcgggtccgttacgggacgggaaccagggttagaagtaacgacgtaacgtgaggctgcgaaccg

SEQ ID NO: 313128 - DNA, 591 bp, Homo sapiens
  misc_feature: GZ8MTXP01AISYR.2.57.F02.1.454.CMB.2.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccacctgtctgcatcagtagganacagagtcaccatcacttgccgggcagtgagagtgtgtcactnttggctggtatcagcaataaaccgaggaaacnccccagaactccagatctatgatcgcctcgagtcgtgggacgggtcgggtcccccagtcgtaagggttcaaggtccgggactaaggtagacgtcgtaggggaactaggtaaacttccaactctaccaaccaactaccaaacaccgcctagaccacgccttagattcgttattttacgaccttaaactttatactacgactaaagtagttagtagggttagttaattcgtccgggtgggttccggttcggaccggaaggggtaaccaagggttcgaaaagttcgaaaacgttcgaggtcgactcgaacccgtaacg

SEQ ID NO: 313129 - DNA, 550 bp, Homo sapiens
  misc_feature: GZ8MTXP01CBX48.2.57.F02.1.454.CMB.2.raw
  modified_base (200)..(200): a, c, t, g, unknown or other
  misc_feature (200)..(200): n is a, c, g, or t
  modified_base (278)..(278): a, c, t, g, unknown or other
  misc_feature (278)..(278): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtagganacagagtcaccatcacttgccggcagtgagagtgttggtcactattggcctggtatcagacaataaaccagggaaacnccccaagaactcctagatctatgatgcctcgagttcgtggggacggggtcggggtccccccagtcgaaagggtttccaaggcggacaaggtagagtcgtaggggaacaaggtaaacttccaacttcaccaaaccataccaaacacgcctgacagccttgactgtattttgactaacttatactgaccaatagtatggtagttaaatgtccggtgggcgttcggcgaacggggacaaggttggaaataacaaacggaattggagctcgcaacc

SEQ ID NO: 313130 - DNA, 549 bp, Homo sapiens
  misc_feature: GZ8MTXP01DRDF8.2.57.F02.1.454.CMB.2.raw
  modified_base (274)..(274): a, c, t, g, unknown or other
  misc_feature (274)..(274): n is a, c, g, or t
  modified_base (535)..(535): a, c, t, g, unknown or other
  misc_feature (535)..(535): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgtgtcatattggctggtatcagacataaaccagggaaacnccccaagaacctcctgactctatgatcgcctcagtctggggagggtcggggtcccccagtacgaaggttcaggccggacaaggtagagtcgtagggacaggtattcactctacaccatcaacacgacctgcagcctagtacttgtattttcgacttaaactttattactcgacctaaataagttatgggtagttaaattgtccgggtgggttcgtttcgggaccgtagggggaacaagggttgaaaatcgaaaagaactgnggctaacgctaacc

SEQ ID NO: 313131 - DNA, 582 bp, Homo sapiens
  misc_feature: GZ8MTXP01EBRZK.2.57.F02.1.454.CMB.2.raw
  modified_base (275)..(275): a, c, t, g, unknown or other
  misc_feature (275)..(275): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtgtcatattggctggatcagcaataaaccgagggaaacnccccaagaacctcctagatctatgatcgcctcgagtcgtgggaggggtcgggtcccccagtcgaaggttcaggtcggcaaggtagatccgtagggactaggtaaattccactctacacctatacaaacgacgcctgacagcctagattgtagttttcgacttaacttatactgacctaaagtagttagtggttaggttaaacttcggtccgggtgggttccggttacgggaccgaaagggggtaacccgttaaagggttaggaaaacctaacgaaaacggtaacgttggacgggactcgcctaaccg

SEQ ID NO: 313132 - DNA, 515 bp, Homo sapiens
  misc_feature: GZ8MTXP01BNOON.2.57.F02.1.454.CMB.2.raw
  modified_base (508)..(508): a, c, t, g, unknown or other
  misc_feature (508)..(508): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggctggtatcagcataaaccagggaaacgccccaagaactcctgatctatgatgcctcagtctgggaggtgggtcccccatcgaaggttcagcggcaagtagatcgtgggacagaattcactctacaccatcgaacagcctagcagcctgattgattttgactaactttatactgacccaatagtatgggtagttaattcgtcggtgggcgttcggccgaagggggaccaagggttgaaatcgaaacgaacgtgtacggntcgcaac

SEQ ID NO: 313133 - DNA, 549 bp, Homo sapiens
  misc_feature: GZ8MTXP01BHYGB.2.57.F02.1.454.CMB.2.raw
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (407)..(407): a, c, t, g, unknown or other
  misc_feature (407)..(407): n is a, c, g, or t
  modified_base (449)..(449): a, c, t, g, unknown or other
  misc_feature (449)..(449): n is a, c, g, or t
  modified_base (463)..(463): a, c, t, g, unknown or other
  misc_feature (463)..(463): n is a, c, g, or t
  modified_base (516)..(516): a, c, t, g, unknown or other
  misc_feature (516)..(516): n is a, c, g, or t
  modified_base (524)..(524): a, c, t, g, unknown or other
  misc_feature (524)..(524): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagagacagagtcacatcacttgccgggcagtgagtgtgttggtcacttagtttggcctggtatcagacaataaaccgagggaaacccccaagacctccngactctangatcgcctcgagtcgtggggcgggtcggacccccagtcgaagggttcaaggccggacaaggtagagtcgaggggactagtacttcactctacacatacaacncgcctgcacgcctagacttgtactttgactaaactttgtacncgaccaagtagttntagggtagttaattcgtcggtgggttccgttcggacggagggaccttaagggnttaaaacncgaaacgcgtggcggctgccgtaac

SEQ ID NO: 313134 - DNA, 572 bp, Homo sapiens
  misc_feature: GZ8MTXP01CF0XV.2.57.F02.1.454.CMB.2.raw
  modified_base (271)..(271): a, c, t, g, unknown or other
  misc_feature (271)..(271): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgtggtcactattgctgatcagcataaaccaggaaacnccccagaactcctgatctatgatcgcctccagtcgtgggaggtgggtcccccagtcgaaggttcaggcggacaaggtagagtcgtagggacagtaattcactctcaacatacaacagcctgcagcctagatgtacttttgacttaaacttattactcgaccaaagtagtagtgggttagttaaattacgtccgggtaggggttccggtttaccgggaccgggtaaagggggacccgttaaaaggggttcggaaaacgttaaccgaaaacggtaacgtggttcgggacttcggccgtaaccg

SEQ ID NO: 313135 - DNA, 495 bp, Homo sapiens
  misc_feature: GZ8MTXP01D40C3.2.57.F02.1.454.CMB.2.raw
  modified_base (274)..(274): a, c, t, g, unknown or other
  misc_feature (274)..(274): n is a, c, g, or t
  modified_base (344)..(344): a, c, t, g, unknown or other
  misc_feature (344)..(344): n is a, c, g, or t
  modified_base (416)..(416): a, c, t, g, unknown or other
  misc_feature (416)..(416): n is a, c, g, or t
  modified_base (485)..(485): a, c, t, g, unknown or other
  misc_feature (485)..(485): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagagacagagtcaccatcacttgccgggcagtgagagtgtggtcactattggctggtatcagcataaaccagggaaacnccccaagaactcctgatctatgatcgcctcagtctggagggtcggtcccccagtacaaggttcaggcggnaagtagatcgtagggacagaattcactctacaccatcaaacagcctgcagcctagatgatttgctaaacttntactgaccaatagtatggtagtaatgtcgtgggcttcgcgaagggacaaggttgaaatcaaagaactgnggctgctaac

SEQ ID NO: 313136 - DNA, 533 bp, Homo sapiens
  misc_feature: GZ8MTXP01B3VWF.2.57.F02.1.454.CMB.2.raw
  modified_base (281)..(281): a, c, t, g, unknown or other
  misc_feature (281)..(281): n is a, c, g, or t
  modified_base (403)..(403): a, c, t, g, unknown or other
  misc_feature (403)..(403): n is a, c, g, or t
  modified_base (443)..(443): a, c, t, g, unknown or other
  misc_feature (443)..(443): n is a, c, g, or t
  modified_base (523)..(523): a, c, t, g, unknown or other
  misc_feature (523)..(523): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcacatcacttgccgggcagtgagagtgttggtcactatttggctggtatcagacaagtaaaccgagggaaacnccccaagaactcctagatctatgatcgcctcgagtcgtggggagggtcgggtcccccagtcgaaggttcaggtcggacaaggtagatcgtagggacagtaattcactctacaacataccaanacgtcctgcagctgattgtattttgactaaactttatacnaccaatagtgtggtagttaatgtccggtgggcgttcggacgtagggggacaagggttcgaaactaacgaagtaacgtggngctcgctaac

SEQ ID NO: 313137 - DNA, 574 bp, Homo sapiens
  misc_feature: GZ8MTXP01EYXYE.2.57.F02.1.454.CMB.2.raw
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtaggagacagagtcaccatcacttgccggcagtgagngtgtgtcatattggctggtatcagcaataaaccgaggaaacnccccagaactccngatctatgatcgcctccgagtcgtggggaggggtcgggtacccccagtacgaaggttcaggacggacaagtagatcggtaggggaacaaggtaacttccactctacaaccgataccaacacgcctagaccacgtcctagtattgttattttacgacttaaactttagtactacgaccaaatagttagtgggttagttaaactttcggtccgggtggggttcgttacggccggaaggggaaccaagggttacgaaataacgaaacgtaacgtggtcgactcgctaaccg

SEQ ID NO: 313138 - DNA, 599 bp, Homo sapiens
  misc_feature: GZ8MTXP01DRQ9Y.2.57.F02.1.454.CMB.2.raw
  modified_base (279)..(279): a, c, t, g, unknown or other
  misc_feature (279)..(279): n is a, c, g, or t
  modified_base (402)..(402): a, c, t, g, unknown or other
  misc_feature (402)..(402): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagagtcaccatcacttgccgggcagtgagtagtgttgtcactattggctggtatcagcaataaaccgaggaaacnccccagaacctcctgatctatgatgccctcagtcgtgggacgggtcgggtacccccagtcgaaggttcgaggcggacaaggtagatcgtagggaactagtaattcactctacacatacaaacncgtcctgactacgcctagtattagttacttttagaccttaaaatttcttaacgcgtaaccctaaagtagttagttacgggttaaggttaactttcggtcccggggtgggttccggttaccgggaccggtaaaggggacccttaaaggggttacgaaacgttaacgaaagtaaccgtgggtcgttactcgcgtaaccg

SEQ ID NO: 313139 - DNA, 520 bp, Homo sapiens
  misc_feature: GZ8MTXP01A2B4A.2.57.F02.1.454.CMB.2.raw
  modified_base (276)..(276): a, c, t, g, unknown or other
  misc_feature (276)..(276): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactatttggcctggtatcagcataaaccaggaaanccccagaactcctgatctatgatgcctcagtctggaggggtcggggtccccccatcgaaggttcagcgggcaagtagatcgtgggacagattcactctacaccatcaacagcctgcagcctgatgattttcgctaaacttnttacngacctaanagttatgggtagtaattagccggtgggcgttcggaccgtagggggaaccaaggttggaaatcgaaaacgaacgttgcgggactgcgaacc

SEQ ID NO: 313140 - DNA, 756 bp, Homo sapiens
  misc_feature: GZ8MTXP01CSJPI.2.57.F02.1.454.CMB.2.raw
  modified_base (202)..(202): a, c, t, g, unknown or other
  misc_feature (202)..(202): n is a, c, g, or t
  modified_base (282)..(282): a, c, t, g, unknown or other
  misc_feature (282)..(282): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacttgccgggcagtgagagtgttggtcactagttggcctggtatcagacaataaaccgaggaaacnccccaagaactcctgatctatgatcgcctcagtcgtggggagggtcggggtaccccccagtacgaaaggtttcaaggtccggactaaggttacggaattcggttagggggaacctaagggtaaactttcccaactttcctaccaaacccgtattacccaaacacggtccccttaggaccaacggtccctaggtaacttagggtttaatttttcggaaacctttaaaactttacgtttaaacctacgtaacccctaaagttaacggtttaacgttacggggtttaaaggtttaaacgtttaacgggtttaaccccggggttgggggttaccccgggttttaacccgggacccgggggtaaaccggggggtaaaacccgttaaagggggtttaaacggaaaaaacgtttaacccgggaaaaaaacggttaaccggttagggtacggggttaactttcccgggaaccgttaaacccg

SEQ ID NO: 313141 - DNA, 561 bp, Homo sapiens
  misc_feature: GZ8MTXP01CTASN.2.57.F02.1.454.CMB.2.raw
  modified_base (278)..(278): a, c, t, g, unknown or other
  misc_feature (278)..(278): n is a, c, g, or t
  modified_base (447)..(447): a, c, t, g, unknown or other
  misc_feature (447)..(447): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactatttggctggtatcagcaataaaccagggaaanccccaagaactcctagatctatgatcgcctccagttcgtgggagggtcggggtcccccagtacgaaggttcaggccgggcaaggtagatcgtggggacagtaaattcactctacaacatacaacagcctgcagcctgatgtatttgactaacttactactcgacctaanagttagtggtagtaaattgtccggtgggttcggtttaccggccggtaaaggggaccgttaaaagggttcggaaaacttcgaaaaaaccgtcgtaggtggaccgtgaacgtaacc

SEQ ID NO: 313142 - DNA, 666 bp, Homo sapiens
  misc_feature: GZ8MTXP01DHJL6.2.57.F02.1.454.CMB.2.raw
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctccaccctgtcctgcatcagtaggagacagagtcaccatcacttgccggcagtgagngtgtggtcactattgctgtatcagcaataaaccaggaaanccccaagaactcctgatctatgatcgctcagtctggaggtcgggtcccccagtcgaaggttcagtccggcaaggtagactcgtacggggaacacggtaaattccaacttcctaccaacctaataccaaaacgcggtccccttaggccaacggtccctagtaattcggttaattttacgaccttaaactttactttacgcggaaccctaaagtaaggttacgttaagggttacggttaaaactttcgggttccccggggttaggggttcccggttttacccggggaacccgggtaaacggggggtaacccgttaaaagggggttaccggaaaaaacgttccggaaaaaacgtaaccggttgggtacgggcttaaccgggaacccgttaaacccg

SEQ ID NO: 313143 - DNA, 578 bp, Homo sapiens
  misc_feature: GZ8MTXP01A29Y9.2.57.F02.1.454.CMB.2.raw
  modified_base (275)..(275): a, c, t, g, unknown or other
  misc_feature (275)..(275): n is a, c, g, or t
  modified_base (451)..(451): a, c, t, g, unknown or other
  misc_feature (451)..(451): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggctgatcagcaataaaccgaggaaacnccccaagaacctcctagatctatgatcgcctcagtcgtggggagggtcgggtcccccagtacgaaggttcaggcggactaaggtagagtcgtagggactaagtaacttcaactctaccaacctataccaacacgcctgaccacgcctgattcgtattttgacttaacttacttacngaccctaagtagttagttaggtagttaacttacgtcgggttcgggttcggttaccggacggtaaacggggaaccttaagggttggaaaactaacgaaaacgtaacgtggaggacctggaactaaccg

SEQ ID NO: 313144 - DNA, 676 bp, Homo sapiens
  misc_feature: GZ8MTXP01D49YT.2.57.F02.1.454.CMB.2.raw
  modified_base (285)..(285): a, c, t, g, unknown or other
  misc_feature (285)..(285): n is a, c, g, or t
tcagacgctcgacacacgaccggtgctcgatttagctcgatatagttgggtttggggcaggcgtcagactcagtcaggacacagcatggacatgagggtccccgctcagctcctgggctcctgctgctctggctcccaggtgccaaatgtgacacccagatgacccagtctcctcccacctgtctgcatcagtagagacagatcaccatcacttgccgggcagtgagtagttgtggtcactagttggcctggtatcagactaagtaaaacccgagggaaaacccncccaagtacctcgtagactactatgtactcgtccctacgtaggtcggtggggacgggtccggtaccccagtacgtaagtccgaggacgagtaaggtacgaacgtcgtacggaactagtaacttaccctactactaccaacaactaccaacgtacgacctacgacgacgtacgtagtaagttacgttaacggtttaacgtaacttaaactttacgtaactacgtaaccgtaaagtaagttaaggttagggttaacgttaacgttacggttcgggtacgggttaccggtacgggaaccgggtaacggggtaaaccgttaaagggttaaacggttaaacgtaaccgtaaaaccggtaacgttacggtacgttaccgtaaccgttaaccgtaacg

SEQ ID NO: 313145 - DNA, 506 bp, Homo sapiens
  misc_feature: GZ8MTXP01B0L1F.2.57.F02.1.454.CMB.2.raw
  modified_base (281)..(281): a, c, t, g, unknown or other
  misc_feature (281)..(281): n is a, c, g, or t
  modified_base (357)..(357): a, c, t, g, unknown or other
  misc_feature (357)..(357): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcaataaacccgagggaaacnccccagaacctcctgatctatgatcgcctccagtctggagggtcgggtcccccagtcgaaggttccaggccgggcnggtagatctggggacagattcactctcacatcaacagcctgcagcctgatgtattttgactaacttattacngaccaanagtatggtagtattgtcggtggcgtcggcgaggggtacaggttggaaatgaaacgaagtgtgctgctaac

SEQ ID NO: 313146 - DNA, 588 bp, Homo sapiens
  misc_feature: GZ8MTXP01DJWYN.2.57.F02.1.454.CMB.2.raw
  modified_base (272)..(272): a, c, t, g, unknown or other
  misc_feature (272)..(272): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcacatcacttgccggcagtgagagtgtgtcatattgctggtatcagcaataaaccgaggaaacnccccaagacctctgatctatgatcgcctcagtcgtgggacgggtcgggtacccccagtacgtaaggttcgaggtcgggactaaggtacgtacgtacgtaggggaacagtaacttccactctacaactatacaaacgacgcctagccagtcctagtaattgttattttacgacttaaacttacttaacctcgaacctaagtaagttagtgggttagttaaattcggtaacggtggttccggttcgggccggaaacggggtacgttaagggacgttaaactaacgaaaacgtaacgtggtacgactaacgcgtaaccg

SEQ ID NO: 313147 - DNA, 545 bp, Homo sapiens
  misc_feature: GZ8MTXP01AFJB1.2.57.F02.1.454.CMB.2.raw
  modified_base (359)..(359): a, c, t, g, unknown or other
  misc_feature (359)..(359): n is a, c, g, or t
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgagacccagatcgacccagtccgtcctcccgacctgtcctgcatcagtaggagacagagtcaccatcacttgccgggcagtgagagtgtggtcactattggctggtatcagcaataaaccgagggaaaccccccaagaacctcctgactctatgatcgcctccagtcgtgggagggtcgggtcccccatcgaaggttccaggccggnaaggtagagtcgtagggacagtacttcacttcncaacagtacaacacgccncncncgctgtatgtagttcgtactacttactactcgacacgtagtagtagtagttagtcgtcggtcggttcggtcggcggacgggaacggacggttacgaacgtaacgaacgtaacgtcgtcgcgtcgcgtaacg

SEQ ID NO: 313148 - DNA, 569 bp, Homo sapiens
  misc_feature: GZ8MTXP01EI4F1.2.57.F02.1.454.CMB.2.raw
  modified_base (202)..(202): a, c, t, g, unknown or other
  misc_feature (202)..(202): n is a, c, g, or t
  modified_base (278)..(278): a, c, t, g, unknown or other
  misc_feature (278)..(278): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtagganacagagtcaccatcacttgccggcagtgagagtgtggtcactattggctggtatcagcaataaaccgagggaaacnccccaagaacctcctgatctatgatcgccctccagttcgtgggacggggtcggggtccccccagttcgaaaggttcaggccggacaaggttagatcgtagggactaagacttcacttctacaacctataccaaacacgcctgcctagcctagtactgttatttcgacttaacttatactgaccctaaagtagttagtggtagttaaacttggtccggttggggttccggttcggaccggaggggtaaccaagggttcgaaactaacgaaacgtaagtgtggctgcctaacg

SEQ ID NO: 313149 - DNA, 629 bp, Homo sapiens
  misc_feature: GZ8MTXP01EEU50.2.57.F02.1.454.CMB.2.raw
  modified_base (203)..(203): a, c, t, g, unknown or other
  misc_feature (203)..(203): n is a, c, g, or t
  modified_base (280)..(280): a, c, t, g, unknown or other
  misc_feature (280)..(280): n is a, c, g, or t
  modified_base (315)..(315): a, c, t, g, unknown or other
  misc_feature (315)..(315): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagagtcaccatcacttgccgggcagtgagagtgtggtcattattggctggtatcagcaataaaccgagggaaacnccccaagactctgatctatgatcgcctcgagtcgngggagggtcggtacccccagtcgaaggttcgaggtccggataaggtagtacgtcgtaggggaactaggtaaacttccacttctaccacatacaaacagccctagcagcctagtattagtacttttgaacctttaaactttacttaacgtacgtaaccctaaagttaaggttacgtttaggggttaacgttaaacgtttacggtcccgggggttaggggttaccgggttaccgggaaccgggtaacgggggaaacccttaaagggggttcgaaaaacttcggaaaacgtaacgtggtacggactcggcctaaccg

SEQ ID NO: 313150 - DNA, 517 bp, Homo sapiens
  misc_feature: GZ8MTXP01AVZVO.2.57.F02.1.454.CMB.2.raw
  modified_base (274)..(274): a, c, t, g, unknown or other
  misc_feature (274)..(274): n is a, c, g, or t
  modified_base (432)..(432): a, c, t, g, unknown or other
  misc_feature (432)..(432): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcacatcacttgccggcagtgagagtgtgtcactattggctggtatcagcaataaaccgaggaaacnccccagaactcctagatctatgatcgcctcgagttcgtgggagggtcgggtcccccagtcgaaggttcaggcggacaaggtagagtcgtaggggaacagtaattcacttctacacatacaacacgcctgcagcctgattgtatttgactaattatacngaccaaagtgttagtgtagtaattgtccggtgggttcgtcggcgaaggggacagggttgaatcgaaacgntggnggctgcgtaac

SEQ ID NO: 313151 - DNA, 505 bp, Homo sapiens
  misc_feature: GZ8MTXP01ARYW6.2.57.F02.1.454.CMB.2.raw
  modified_base (232)..(232): a, c, t, g, unknown or other
  misc_feature (232)..(232): n is a, c, g, or t
  modified_base (277)..(277): a, c, t, g, unknown or other
  misc_feature (277)..(277): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
  modified_base (495)..(495): a, c, t, g, unknown or other
  misc_feature (495)..(495): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagngtgtggtcactattggctggtatcagcaataaaccgagggaaacnccccaagaacctcctgatctatgatcgcctcagtcgtgggacgggtcgggtcccccagtcgaaggtcaggacggcaagtagagtcgtagggacagtactcactctcacatacacacgcctgcagctagatgtatttgactaattntacngacaatgtntggtagtaatgtcggtggttcgtcggcggtagggaccaaggttgaactaacgaaagtcgngtgctgcaac

SEQ ID NO: 313152 - DNA, 536 bp, Homo sapiens
  misc_feature: GZ8MTXP01AYEZU.2.57.F02.1.454.CMB.2.raw
  modified_base (277)..(277): a, c, t, g, unknown or other
  misc_feature (277)..(277): n is a, c, g, or t
  modified_base (350)..(350): a, c, t, g, unknown or other
  misc_feature (350)..(350): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggcctggtatcagcaataaaccagggaaanccccagaacctcctgatctatgatgcctcagtcgtgggagggtggggtcccccagtcaaggttcaggcggacngtagatctgggacagaattcactctcaccatcaacagcctgcagcctgattgtattttgactaacttattaactgacctaaagagttatagggtaggttaaacttagtcccggtgggttcgttccggacgtaagggggtaccaagggttgaaaactcgaaaacgtaagtggtcggctcgcgtaacc

SEQ ID NO: 313153 - DNA, 667 bp, Homo sapiens
  misc_feature: GZ8MTXP01D9DW0.2.57.F02.1.454.CMB.2.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (359)..(359): a, c, t, g, unknown or other
  misc_feature (359)..(359): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacttgccgggcagtgagagtgtgtcatattggctggtatcagcaanaaacgaggaaacnccccagaactccngatctatgatcgcctcgagtcgtgggaggtcgggtcccccagtcgaaggtcaggtcggacaagtagagttnacgtacggaacgtaacgtaacgttaccttacctaccctaacctaaccctaaacctaccgaaccgtaaccgtaccgtacgggtaccgtacgtaccgttacgtacgtttacgttacgtttaacgtttaactttaaactttaacgttaaccgttaaccgtaaccgttaaacgttaaacggtttaaggtttaaacggtttaacgggtttaacggtttaacgggttaccgggtttccggggttaccgggttaaccggggtaccgggtaacgggtaacggtaaacggttaaacggtaaacgttaaacgtaaacg

SEQ ID NO: 313154 - DNA, 615 bp, Homo sapiens
  misc_feature: GZ8MTXP01EFR9J.2.57.F02.1.454.CMB.2.raw
  modified_base (279)..(279): a, c, t, g, unknown or other
  misc_feature (279)..(279): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggctggtatcagacaataaaccgagggaaacnccccaagaacctcctgatctatgatcgcctcagtcgtgggaggggtcgggtcccccagtcgaaggttcacggcggacaaggttagagtcgtagggaacagtaacttcactctacacatacaacacgcctgcagcctgtattcgtattttcgacttaactttattactgacctaaataagttgtaggggttagttaaagtttcggtaacccgggttggggttcccggtttccgggaccggtaaacgggggtaacccgttaaaagggggttcggttaaaaacgttaacccggaaaaaacggtaacgttcgggtacgggttcgtaacggccctaacccg

SEQ ID NO: 313155 - DNA, 663 bp, Homo sapiens
  misc_feature: GZ8MTXP01BQJ6D.2.57.F02.1.454.CMB.2.raw
  modified_base (286)..(286): a, c, t, g, unknown or other
  misc_feature (286)..(286): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcagtagagacagagtcaccatcacttgccggcagtgagtagtgttggctacttagttggcctggtatcagacaagtaaaccgagggaaacnccccaagacctctagactactatgactcgcctcgaggtcgtaggggacggggtcgggtacccccagttacgtaagggttcaggacggactaaggtagaacgtcgtaggggaactagtaacttccactctacaacctatacgaaacacggtccctgaccagtacctggtaactttgttattttacgacttaaactttactacgtacgtacctaaagttagttagttgggttaacgttaacgttccggtccggggtcggggttaccgggttccgggaacgggtaaaccgggggtaaccgttaaaggggttacggttaaaaccgttaaccggaaaacggtaaccggttgggttacgggaccgttaacggaaccttaaccg

SEQ ID NO: 313156 - DNA, 544 bp, Homo sapiens
  misc_feature: GZ8MTXP01D4YZR.2.57.F02.1.454.CMB.2.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
  modified_base (346)..(346): a, c, t, g, unknown or other
  misc_feature (346)..(346): n is a, c, g, or t
  modified_base (390)..(390): a, c, t, g, unknown or other
  misc_feature (390)..(390): n is a, c, g, or t
  modified_base (430)..(430): a, c, t, g, unknown or other
  misc_feature (430)..(430): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgaccacccagatgacccagtctccctcccaccctgtctgcatcagtaggagacagagtcaccatcacttgccgggcagtgagngtgtgtcatnttgctggtatcagcaataaaccgaggaaacnccccagacctcctagatctatgatcgcctcagtcgtgggaggggtcggtccccagtcgaaggtcagcggnaaggtagatcgtaggggacagtaattcactctacacatacaacncgcctgcagcctgattgtatttcgacttaacttattaccngacctaaagtagtattgggtagttaacttggtcccggtgggttcgttcgggacggaacggggtaacgaaggttacggaaataaccgaaaaggtcgtggtaggctaacgctaacc

SEQ ID NO: 313157 - DNA, 633 bp, Homo sapiens
  misc_feature: GZ8MTXP01C61Y4.2.57.F02.1.454.CMB.2.raw
  modified_base (202)..(202): a, c, t, g, unknown or other
  misc_feature (202)..(202): n is a, c, g, or t
  modified_base (282)..(282): a, c, t, g, unknown or other
  misc_feature (282)..(282): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagatcaccatcacttgccggcagtgagagtgttggtcacttagttggcctggtatcagacaataaaccgagggaaacnccccaagaacctcctagatctatgatcgcctccgagtcgtaggggaggggttcggggtacccccctaggtacgtaaggttcaaggcggacaaggtagagtcggtaggggaactaaggtaacttccgacttctaccaaccataccaaacgacgccctagaccacgccgtagtaagttgttaagtttttcgaactttaaactttacttactacgacctaaagttagttagtgggttagttaacttcggttccgggtgggttccggttacggaccggtaaacgggggaaccgttaaagggttacgaaaacgttaacgaaaacgtaacgttggtcggaccgtcgaaccgtaaccg

SEQ ID NO: 313158 - DNA, 552 bp, Homo sapiens
  misc_feature: GZ8MTXP01BH842.2.57.F02.1.454.CMB.2.raw
  modified_base (276)..(276): a, c, t, g, unknown or other
  misc_feature (276)..(276): n is a, c, g, or t
  modified_base (446)..(446): a, c, t, g, unknown or other
  misc_feature (446)..(446): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgtgtcactattggctggtatcagcaataaaccgagggaaacnccccaagaacctcctgatctatgatcgcctcagtcgtgggaggggtcgggtcccccagtacgaaggttcaggcgggacaaggtagtagtcgtaggggacaggtaactttcacttctaccacatacaacacgcctgccagcctagattgtattttcgactaactttatacncgaccaagtagttatggtagtaacttgcgtgggttcgttcggacgaaggggaccaaggggttcgaaacgtaacgaaaacgtaacgtggtcggacctgccgtaaccg

SEQ ID NO: 313159 - DNA, 545 bp, Homo sapiens
  misc_feature: GZ8MTXP01DRMW0.2.57.F02.1.454.CMB.2.raw
  modified_base (279)..(279): a, c, t, g, unknown or other
  misc_feature (279)..(279): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagagacagagtcaccatcacttgccggcagtgagagttgtgtcactattggcctggtatcagacaagtaaaccgagggaaacnccccaagaactcctagacttctatgatcgtcctcagttcgtgggagggtcgggtccccagtacgaggttcaggcgacaagtagatcgagggacagtattcactncacatcaacncgcctagcagctagattcgtatttgacttaacttnttacngacctaaagtagttagtggttaagtaacttgtcggtgggttcgttcgggacgtaaggggaaccttaagggttagaaacttcgaaaacgtcgtgggacgttcctgaactaacg

SEQ ID NO: 313160 - DNA, 896 bp, Homo sapiens
  misc_feature: GZ8MTXP01B18RG.2.57.F02.1.454.CMB.2.raw
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtaggagacagagtcaccatcactgccgggcagtgagtagtgttggtctacttagttcggcctggtatcgaagacctaaacgtaaaacccgaacgggaaaccgcccccgaaacgtaaacctcccgtagtactaccgttaagtggtaacttccggtccccttaccggtacggttccgggttacggggggtaaacggggggtttccgggggttaacccccccctaaggttaaccggtaaacggggttaccgaacggggtaacccggggaccgtaagggttaacgggtacgtttaccgggtaacggggtaaaccgtaacggttaaactttcccgaaccctttcctaaccccaaaccgtacttaacccgaaaaccgtaccggtccccgtacgaccgaaaccgggttccttaaggtaagtttacggtttaatttttcggaaacctttaaaaccttttacggttaacccgacctaacccgttaaaaggttaggtttaaaccgggtttggggtttaaaacgttaaccgttttaccgggtcccggggggtttacggggttacccgggttcccgggggaaacccggggtaaaaggggggttaaccccttaaaaaggggggttaacttaaaaacccgggtttaaaccggaaaacccggggttaaacgttgggggttccgaccgggtttaacccgaaccttaaaccccggg

SEQ ID NO: 313161 - DNA, 547 bp, Homo sapiens
  misc_feature: GZ8MTXP01EGBTU.2.57.F02.1.454.CMB.2.raw
  modified_base (201)..(201): a, c, t, g, unknown or other
  misc_feature (201)..(201): n is a, c, g, or t
  modified_base (277)..(277): a, c, t, g, unknown or other
  misc_feature (277)..(277): n is a, c, g, or t
  modified_base (448)..(448): a, c, t, g, unknown or other
  misc_feature (448)..(448): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccggcagtgagagtgtgtcactagttggctggtatcagacaataaaccgaggaaacnccccaaagaacctcctgatctatgatcgcctcagtcgtgggagggtcggtcccccatcgaaaggttcaggcggactaaggtaagagtcgtagggaactagtaacttcactctacaaccatacgaacagcctgcagcctagattgtattttacgacttaaacttattaccgngacctaaagtagttagtggttagtaaattcgtcggtgggttcgtcggacgacggggaacttaaggttcgaaataacaaaacgtgtgagctgttccgaac

SEQ ID NO: 313162 - DNA, 585 bp, Homo sapiens
  misc_feature: GZ8MTXP01A2ZCQ.2.57.F02.1.454.CMB.2.raw
  modified_base (203)..(203): a, c, t, g, unknown or other
  misc_feature (203)..(203): n is a, c, g, or t
  modified_base (284)..(284): a, c, t, g, unknown or other
  misc_feature (284)..(284): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagactcaccatcacttcgccgggcagtgagagttgtggtcacttattggcctggtatcagcaataaaccgagggaaacnccccagaacctcctagatctatgatcgcctcagtcgtggggacgggtcgggtcccccagtacgaaggttcaggcgggctaagtagagtcgtagggacagtaattcactcacacatacaacagacctgacagtcctagtattgtattttcgacttaaactttacttactacgacctaacgtaagttagtagggtaggttaaatcggtcgggtacgggttccggttaccggacggtaagggggaaccgttagggttaggaaaccttaacgaaacgtaacgttggacggctaacgcgtaacccg

SEQ ID NO: 313163 - DNA, 537 bp, Homo sapiens
  misc_feature: GZ8MTXP01CKFS5.2.57.F02.1.454.CMB.2.raw
  modified_base (201)..(201): a, c, t, g, unknown or other
  misc_feature (201)..(201): n is a, c, g, or t
  modified_base (278)..(278): a, c, t, g, unknown or other
  misc_feature (278)..(278): n is a, c, g, or t
  modified_base (397)..(397): a, c, t, g, unknown or other
  misc_feature (397)..(397): n is a, c, g, or t
  modified_base (438)..(438): a, c, t, g, unknown or other
  misc_feature (438)..(438): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgtggtcactattggctggtatcagcaataaaccgagggaaacnccccaagaacctcctagatctatgatcgcctcagtcgtgggagggtcgggtcccccatcgaaggttcaggcggacaagtagagtcgtagggacagtaactcacttcacacatacaaacncgcctgcagcctagattgtacttttgacttaaacttatacncgaccaagtagtagtggttagtaattcgcgggtgggcgttcggacggaaggggaccaagggttgaaactcgaaacgtaacgtggtacggctcgctaacc

SEQ ID NO: 313164 - DNA, 573 bp, Homo sapiens
  misc_feature: GZ8MTXP01CH4ZG.2.57.F02.1.454.CMB.2.raw
  modified_base (203)..(203): a, c, t, g, unknown or other
  misc_feature (203)..(203): n is a, c, g, or t
  modified_base (280)..(280): a, c, t, g, unknown or other
  misc_feature (280)..(280): n is a, c, g, or t
  modified_base (455)..(455): a, c, t, g, unknown or other
  misc_feature (455)..(455): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagagtcaccatcacttgccgggcagtgagtagtgtggtcattagttggctggtatcagcaataaaccgaggaacncccagactctgatctatgactcgcctcgaggtcgtggggacggggtcggtccccccagtacgaaggttcacggccgggactaaggtagtacgtcggtagggaacaggtaacttcactctacacatacaacacgcctgcagcctagattcgttattttcgaacttaacttattacncgaccaagtagttagtaggttagttaacgttgtccgggtgggttcgtcggacggtaacggggtacttaagggttacgttaaactaacgaaacggtcgttggcgttctcgaacctaacg

SEQ ID NO: 313165 - DNA, 661 bp, Homo sapiens
  misc_feature: GZ8MTXP01AGHV8.2.57.F02.1.454.CMB.2.raw
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
  modified_base (352)..(352): a, c, t, g, unknown or other
  misc_feature (352)..(352): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagngtgtgcactattgctggtatcagcaataaaccgagggaaacnccccaagaacctcctgactctatgatcgcctcgagtcgtgggaggggtcgggtcccccagtcgaaggtcagcggacgngtagactcgtagggactaggtacttcaccttctaccaacctaataccaaacgcgccccgtaggaccacggtcccttaggtaacttggtaacttttttacggaaccttaaaccgtttactttaaccgtcggaacccctaaaggtagtttaaacgttggggttaagggttaaactttacggggttcccgggtgggggttacccggtttacccggggacgggtaaaccgggggtaaccgttaagggggttaacggaaaacgttaacccgaaaacggtaacgttggttacggggcttaacggcccgtaacccg

SEQ ID NO: 313166 - DNA, 567 bp, Homo sapiens
  misc_feature: GZ8MTXP01ATK6L.2.57.F02.1.454.CMB.2.raw
  modified_base (280)..(280): a, c, t, g, unknown or other
  misc_feature (280)..(280): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgaccccagtctcctcccaccctgtctgcatcagtaggagacagagtcaccatcacttgccgggcagtgagagtgtggtcactattggcctggtatcagcaataaaccgagggaaacnccccagaactcctgatctatgatcgcctcagtcgtgggagggtcgggtcccccagtcgaaggttcaggcggcaagtagatcgtgggacagaattcactctacacatcaacagcctgcagtcctgacttgtattttgactaaacttattactgaccctaaatagttagtgggttaggttaaactttagtcccgggtggggttcgtttaccggggccgtaaagggggaacccaaggggttacggaaacgttaaccgaaacggtaacgtggtacggctaacggctaaccg

SEQ ID NO: 313167 - DNA, 616 bp, Homo sapiens
  misc_feature: GZ8MTXP01AQDN0.2.57.F02.1.454.CMB.2.raw
  modified_base (280)..(280): a, c, t, g, unknown or other
  misc_feature (280)..(280): n is a, c, g, or t
  modified_base (414)..(414): a, c, t, g, unknown or other
  misc_feature (414)..(414): n is a, c, g, or t
  modified_base (453)..(453): a, c, t, g, unknown or other
  misc_feature (453)..(453): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctccatcagtaggagacagagtcaccatcacttgccgggcagtgagagtgttgcacttagttggctggtatcagacaataaaccgagggaaacnccccaagaacctcctagactctatgatcgccctcgaggtcgtgggagggtcggggtccctagtacgtaaggttcaggccggagtaagtaagatcgtaggggacagtaacttcacttcacaacctataccaaacncgtcctgcacgcctagattgtatttggacttaaactttntacgtgacctaagtagttagtgggtacgtttaattcggcccgggttggggtaccgtttaccgggggaccgaaggggggtaaacccgtaaaggggttacggttaaaacgttaccggtaaaaaccggtgttggtcggggaccttacgggaaccttaacgttaacg

SEQ ID NO: 313168 - DNA, 552 bp, Homo sapiens
  misc_feature: GZ8MTXP01CNB16.2.57.F02.1.454.CMB.2.raw
  modified_base (283)..(283): a, c, t, g, unknown or other
  misc_feature (283)..(283): n is a, c, g, or t
  modified_base (402)..(402): a, c, t, g, unknown or other
  misc_feature (402)..(402): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtaggagacagagtcaccatcacttgccgggcagtgagagtgttggtcactatttggcctggtatcagcaataaaccgagggaaacnccccagaacctcctgatctatgatcgcctcgagttcgtgggaggggtcggggtacccccatcgaaggttcaggcggacaagtagatcgtgggacagtaactcactctacacatcaacancctgcagcctgatgtatttgacttaacttactactcgacctaagtagtagttgggtagttaattgtcccggtgggttcggttcggccgtaaggggccaagggttaggaaacgtaacgaaacggtaacgtggtacggcgtcgaactaaccg

SEQ ID NO: 313169 - DNA, 544 bp, Homo sapiens
  misc_feature: GZ8MTXP01B4IEU.2.57.F02.1.454.CMB.2.raw
  modified_base (202)..(202): a, c, t, g, unknown or other
  misc_feature (202)..(202): n is a, c, g, or t
  modified_base (283)..(283): a, c, t, g, unknown or other
  misc_feature (283)..(283): n is a, c, g, or t
  modified_base (355)..(355): a, c, t, g, unknown or other
  misc_feature (355)..(355): n is a, c, g, or t
  modified_base (396)..(396): a, c, t, g, unknown or other
  misc_feature (396)..(396): n is a, c, g, or t
  modified_base (532)..(532): a, c, t, g, unknown or other
  misc_feature (532)..(532): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtagganacagagtcacatcacttgccgggccagtgagagtgttggtcacttatttggcctggtatcagcaataaaccgagggaaacnccccagaactcctagatctatgatcgcctcagtctgggagggtcgggtcccccagtcgaaggtcaggcgacnggtagatcgtagggacagtaacttcactcacaacatacaanacgcctgcagcctagattgtattttgacttaattatactgaacctagtagtgtggttagttaattggtccggttggggccggttacggaccgtaaggggaccttaagggttagaagttaacgaaacggtgtgggtnacgtgcctaacg

SEQ ID NO: 313170 - DNA, 601 bp, Homo sapiens
  misc_feature: GZ8MTXP01CT0TT.2.57.F02.1.454.CMB.2.raw
  modified_base (284)..(284): a, c, t, g, unknown or other
  misc_feature (284)..(284): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagagtcaccatcacttgccgggcagtgagagtgttggtcacttatttggcctggtatcagacaataaaccgagggaaacncccccaagaacctcctagatctatgatcgcctcagtcgtgggagggtcgggtcccccagtcgtaaggtcaggcggcaagtagatcgtagggacagtatcactctacacctataccaacgagccctgaccacgtcctagaattcgttattttcgaaccttaaacgtttataccgtcgaccctaaatggttaatgggttagttaaacttcgtccgggtcgggttcggtttccgggaccgtaaacgggggtaccttaaagggggttcggaaaactaaccggaaaaacgtcgtagggtcgggacttaacggccgtaacccg

SEQ ID NO: 313171 - DNA, 583 bp, Homo sapiens
  misc_feature: GZ8MTXP01EIBOK.2.57.F02.1.454.CMB.2.raw
  modified_base (285)..(285): a, c, t, g, unknown or other
  misc_feature (285)..(285): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtcctgcatcagtaggagacagagtcaccatcacttgccggcagtgagagtgtggtcacttattggcctggtatcagacaagtaaacccgagggaaaaccnccccaagtacctcctagactctatcgactccgcctcgagtcgtaggggtacgggtcggtaccccagtacgaacggtcacggcggactaaggtagtacgtcggtaggactaagtacttccactctacacanacaacncgctgcagctatattcgttagtttcgaacttaacttactactacgactaagtagttagtggtagttaattcgtcggttgggttaccgtaccgggacggtaacggggtaaccgaaggttaacggaaactaacgaaacgtcgtaggtcgcgtcgaaccgtaacg

SEQ ID NO: 313172 - DNA, 620 bp, Homo sapiens
  misc_feature: GZ8MTXP01B2Z5U.2.57.F02.1.454.CMB.2.raw
  modified_base (276)..(276): a, c, t, g, unknown or other
  misc_feature (276)..(276): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagagacagagtcacatcacttgccggcagtgagagtgtggtcactattggctggtatcagacaataaaccgagggaaacnccccaagaactcctgatctatgactcgcctccgagtcgtgggagggtcgggtccccccagtcgaaggttccaaggcggactaaggtagagtcgtaggggactaagtaattccaacttctaccaaccataccaaacgacgtccctgaccagtcctaggtattacggtttattttacgacttaaacctttagttaacctcgtaaccctaagtaagtttagttaggggttaagttaaactttcggtaaccggggttgggccggtttaccgggccgtaaacgggggaaccttaaggggttagaaaacgttcgaaaaccggtaagtcggtaggacctcgaacctaaccg

SEQ ID NO: 313173 - DNA, 681 bp, Homo sapiens
  misc_feature: GZ8MTXP01CYD8B.2.57.F02.1.454.CMB.2.raw
  modified_base (199)..(199): a, c, t, g, unknown or other
  misc_feature (199)..(199): n is a, c, g, or t
  modified_base (274)..(274): a, c, t, g, unknown or other
  misc_feature (274)..(274): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctccacctgtctgcatcagtagganacagagtcacatcactgccggcagtgagagtgtggtcacttattggctggtatcagcaataaaccgagggaaacnccccagaacctctagactctatgactcgcctcagtcgtgggacgggtcgggtacccccagtacgaaggttcacggacggacaagtacgagtcggtaggggaacaagttaactctacttactaccaactaataccaacacggtccctaggaccaacggtccttaggtatttacggttaacgtttttacgaaacctttaaacgtttaacttaaccgtaccggaaccctaaacggttaggttaacgttacggggtttaaggttaaacgtttaccggtcccgggggtttcgggggttaccggtttaccgggggaccgggtaaacgggggtaacccgttaaagggggttaccggaaaaacgttaaccgaaaaacgggtcgttggggtacggaccttaacggaaccgtaaccg

SEQ ID NO: 313174 - DNA, 561 bp, Homo sapiens
  misc_feature: GZ8MTXP01BI6YZ.2.57.F02.1.454.CMB.2.raw
  modified_base (276)..(276): a, c, t, g, unknown or other
  misc_feature (276)..(276): n is a, c, g, or t
  modified_base (435)..(435): a, c, t, g, unknown or other
  misc_feature (435)..(435): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagagtcacatcacttgccggcagtgagagtgtggtcactattggctggtatcagcaataaaccgaggaaacnccccaagaacctctgatctatgatcgcctcagtcgtgggagggtcgggtcccccagtcgaaggttcaggcggcaagtagagtcgtagggaacagtacttcactctacaccatacaacacgcctgcagtcctagtatgttatttcgacttaacttatacncgacctaatagttatgggttagttaacttcgtcgggttgggttcgttacgggccggtaacggggaccgttaagggttacgttaaactaacggaaaaccgtaagttaggtgggacctcggcctaacg

SEQ ID NO: 313175 - DNA, 539 bp, Homo sapiens
  misc_feature: GZ8MTXP01A6L7T.2.57.F02.1.454.CMB.2.raw
  modified_base (277)..(277): a, c, t, g, unknown or other
  misc_feature (277)..(277): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggctggtatcagcaataaaccagggaaacnccccaagaactcctgatctatgatcgcctcagtcgtgggaggggtcgggtcccccatcgaaggttcaggcggacaaggtagagtcgtaggggacagtaacttccacttctacaaccataccaacgacgcctagacacgtcctagacttgtattttcgacttaacttattactgacctaatagtatggtagttaatcgtcggtgggcgttcggacgtaaggggaccagggttcgaataacgaaagtctggcggactgcctaac

SEQ ID NO: 313176 - DNA, 560 bp, Homo sapiens
  misc_feature: GZ8MTXP01BPY0Q.2.57.F02.1.454.CMB.2.raw
  modified_base (281)..(281): a, c, t, g, unknown or other
  misc_feature (281)..(281): n is a, c, g, or t
  modified_base (295)..(295): a, c, t, g, unknown or other
  misc_feature (295)..(295): n is a, c, g, or t
  modified_base (352)..(352): a, c, t, g, unknown or other
  misc_feature (352)..(352): n is a, c, g, or t
  modified_base (433)..(433): a, c, t, g, unknown or other
  misc_feature (433)..(433): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagatcacatcacttgtcgggcagtgagtagtgttggtcactatttggcctggtatcagacaataaaccgagggaaacnccccaagaactccngatctatgatcgcctcagtcgtgggagggtcgggtccccagtcgaaggtcagcgganaagtagatcgtagggacagtacttcactctacacatacaacagcctgcagcctgtattgtattttgacttaacttattacncgaccaagtagttagtgggttaagttaattcggtcggtgggttaccgttcggacccggtaaggggtaaccgaaggggttacgaaaacgtaacgaaaacggtaagttgggacggttctcgccgtaacg

SEQ ID NO: 313177 - DNA, 580 bp, Homo sapiens
  misc_feature: GZ8MTXP01DOZYD.2.57.F02.1.454.CMB.2.raw
  modified_base (281)..(281): a, c, t, g, unknown or other
  misc_feature (281)..(281): n is a, c, g, or t
  modified_base (369)..(369): a, c, t, g, unknown or other
  misc_feature (369)..(369): n is a, c, g, or t
tcagacgctcgacacacgaccggtgctcgatttagctcgatatagttggggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagagacagagtcaccatcacttgccgggcagtgagtgtgtggtcactattggctggtatcagacaataaaccgagggaaacnccccaagaacctctagactctaatgatcgcctccgaggttcgtgggacgggtcggtaccccagtacgtaggttcaggccggatggtanacgtcgtagggaacagtacttcacttcacacatacaacacgctgcagctgtattgtatttcgacttaactttattactacgacctaaagtagttagtggttacgttaagttcggtccgggtagggttccgggttcggaccgtaagggggaaccttaaagggttcggaaaacgttaacgaaaacgtcgtggtacggttactcgaactaaccg

SEQ ID NO: 313178 - DNA, 641 bp, Homo sapiens
  misc_feature: GZ8MTXP01ADNOA.2.57.F02.1.454.CMB.2.raw
  modified_base (203)..(203): a, c, t, g, unknown or other
  misc_feature (203)..(203): n is a, c, g, or t
  modified_base (280)..(280): a, c, t, g, unknown or other
  misc_feature (280)..(280): n is a, c, g, or t
  modified_base (413)..(413): a, c, t, g, unknown or other
  misc_feature (413)..(413): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctccccaccctgtctgcatcagtagganacagagtcaccatcacttgccgggcagtgagagtgtggtcactagttggctggtatcagcaagtaaaccgaggaacnccccaagacctctgatctatgatcgcctcgagtcgtgggacgggtcgggtaccccagtcgaaggtcaggacggactaaggtagtacgtcgtaggggaacctagtaaacttcactcctacaacctactacaacncgcctgaccagtccgtagtacgttagttaagtttttcgaactttaaactttaacgtttacccgtacgaaccttaaacgttaggttaacgttaggggttaacgtttaaacgtttcggtccggggtaggggttccgggttaccgggaccggaaacgggggaaccgttaaaggggttaagttaaaccgtaacggaaacgtaacgttcggacgttctaacggaacctaaccg

SEQ ID NO: 313179 - DNA, 562 bp, Homo sapiens
  misc_feature: GZ8MTXP01A99DF.2.57.F02.1.454.CMB.2.raw
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
  modified_base (414)..(414): a, c, t, g, unknown or other
  misc_feature (414)..(414): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtaggagacagagtcaccatcacttgccgggcagtgagagtgtgtcactattgccnggtatcagcaataaaccgagggaaacnccccaagaacctcctgatctatgatcgcctccgagtcgtgggacggggtcgggtcccccagtcgaaggttcaggcgggacaaggttagatcgtaggggacaggaacttcactctacacatcaacagctgcagcctnatgattttgactaaacttatactcgacctaagtagttagttgggtagttaacttacgttccgggtagggttcggttcgggaccgtaagggggaccaaggggttcgaaaacgttaacaaaccggtaatcggtaggctcgaacctaaccg

SEQ ID NO: 313180 - DNA, 610 bp, Homo sapiens
  misc_feature: GZ8MTXP01CRBCG.2.57.F02.1.454.CMB.2.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacttggccggcagtgagngtgtggtcactattggctggtatcagcaanaaaccgagggaaacnccccaagactccagatctatgatcgcctcagtcgtggggagggtcgggtacccccagtacgaaggttcgaaggccgggactaagtagaatcggtagggaacagtaacttcactactaccaacctatacaacacgcctagaccacgtctagtaactgttagttttacgacttaaacttatactacgacctaagtaagttagtgggtagttaagtacgtcccgggtgggttccggttcggaccggtaaacgggggtaaccttaaaggggttaacggttaaaactaaccggtaaaaaacgtcggttagggtacgcgttaacgaaccgttaaccg

SEQ ID NO: 313181 - DNA, 556 bp, Homo sapiens
  misc_feature: GZ8MTXP01DFHMD.2.57.F02.1.454.CMB.2.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtagganacagagtcaccatcacttgccggcagtgagngtgttggtcatattggctggtatcagcaataaaccgaggaaacnccccagaactcngatctatgatcgcctcgagtcgtgggaggtcgggtccccatcgaagtcagcganaagtagntcgtagggacagtaattcactctacaccatacaactacgcctgacacgtcctggtactgttattttacgacttaaactttactactacgacctaacgtaagtagttaggtaggttaacttaggtccggtggggttcgttacgggaccgtaagggggaccaagggttacggaaaactcgtaaaacggcgttagggtaggctcgctaacc

SEQ ID NO: 313182 - DNA, 623 bp, Homo sapiens
  misc_feature: GZ8MTXP01EBC3M.2.57.F02.1.454.CMB.2.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (309)..(309): a, c, t, g, unknown or other
  misc_feature (309)..(309): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctccccaccctgtctgcatcagtaggagacagagtcacatcacttgccgggcagtgagagtgtgtcatnttggctggtatnagcaataaaccgagggaaacnccccaagaactctgatctatgatcgccctcgngttcgtggggacggggtcgggtacccccagtacgtaaggtcgaggacggcgtaaggtagtacgtcggtagggaactaagtaactttccaccttctaccaccattaccaaactacgcctgacagcctagtattgttatttcgactttaaactttatacctgaccctaagtagtttagtggttagttaacttcgggtccgggttggggttccggttaccgggaccggtaaacgggggtaaccgttaaaggggttacggttaaaaaccgtaacgaaaacccggtaagttcggtacggcgttaaccggaacctaaccg

SEQ ID NO: 313183 - DNA, 634 bp, Homo sapiens
  misc_feature: GZ8MTXP01AU5TU.2.57.F02.1.454.CMB.2.raw
  modified_base (249)..(249): a, c, t, g, unknown or other
  misc_feature (249)..(249): n is a, c, g, or t
  modified_base (299)..(299): a, c, t, g, unknown or other
  misc_feature (299)..(299): n is a, c, g, or t
tcagacgctcgacacacgaccggtgctcgatttagctcgatatagttgggtttgggggcaggcgtcagactcagtcaggatacagcatggacatgagggtccccgctcagctcctggggctcctgctgctctggctcccaggtgccaaatgtgaccacccagatcgacccagtcctccctcccaccctgtcctgcatcagtaggagacagacgtcaccatcacttgccgggcagtgagtgtgtgcactnttgctgtatcagcaagtaaaccgagggaacccccagaactcctgatctangatcgcctcgaggtcgtgggcggtcggtcccccagtcgaaggtcacggtcgactaagtagatcgtagggacagtaacttcgactctaccaactactaccgaaacgcgtccgtacgacctacggtacctaggtaagttctttacgggtttaacacctttaaaactttcttacaccgaacctaagtagttaacgttgggtaacgtttaacgtcggttcccgggtggggttcccggttaccgggacccgggtaaaggggtaaacccgttaaggggttaccgttaaaacgtaaccggtaaaaggtaacgttcggtacggccccttgaaccccgttaacg

SEQ ID NO: 313184 - DNA, 571 bp, Homo sapiens
  misc_feature: GZ8MTXP01ARQ0A.2.57.F02.1.454.CMB.2.raw
  modified_base (278)..(278): a, c, t, g, unknown or other
  misc_feature (278)..(278): n is a, c, g, or t
  modified_base (496)..(496): a, c, t, g, unknown or other
  misc_feature (496)..(496): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgttggtcactattggctggtatcagcaataaaccgagggaaacnccccaagaacctcctagactctatgatcgccctccgagtccgtggggaggggtcggggtccccccagtcgaaggttcgaggcggacaagtagagtcgtggggactagtaacttcactctaccactagtccaaagacgtccctggaccacgtccttgattcggtaattttcgaacttactttatactgaccaatagtatggtagttaactggtcccggngggttccgtacgggcgtaacggggaacttagggttagaaacttaacgaaacgtaagtcggtaggctcgctaaccg

SEQ ID NO: 313185 - DNA, 586 bp, Homo sapiens
  misc_feature: GZ8MTXP01CX6A9.2.57.F02.1.454.CMB.2.raw
  modified_base (231)..(231): a, c, t, g, unknown or other
  misc_feature (231)..(231): n is a, c, g, or t
  modified_base (274)..(274): a, c, t, g, unknown or other
  misc_feature (274)..(274): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctccaccctgtctgcatcagtaggagacagatcaccatcacttgccgggcagtgagngtgtgtcatagttgctgtatcagacaataaaccgagggaaacnccccaagaactcctagatctatgatcgcctcgagtcgtgggagggtcgggtacccccagtcgtaaggtcaggacggacaaggtagatcgtagggaacagtactcacttcaccacataccaacgacgcctgacacgtctagtattgttattttcgaactttaaactttataactcgaacctaaagtaggttatggggttaacgtaactttcggccggggttgggttacccgttacgggaccgtaaacgggggaacttaaggggaacggttaaactaacggaaaacgttcgtagggtcggactcgaaccgtaac

SEQ ID NO: 313186 - DNA, 572 bp, Homo sapiens
  misc_feature: GZ8MTXP01D6CTB.2.57.F02.1.454.CMB.2.raw
  modified_base (272)..(272): a, c, t, g, unknown or other
  misc_feature (272)..(272): n is a, c, g, or t
  modified_base (441)..(441): a, c, t, g, unknown or other
  misc_feature (441)..(441): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtagagacagagtcacatcacttgccggcagtgagagtgtgtcatattggctggtatcagacataaaccaggaaacnccccagaactctgatctatgatcgcctcagtcgtggagggtcgggtcccccagtcgaaggttcaggcggacaaggtagagtcgagggaacagtaactttcacttctacaacataccaaacacgtcctgacagcctggattggtaattttcggacttaactttattaacncgaccctaaagtagttagtgggttagttaacttcggttccgggtgggttccggttacgggaccggtaagggggaaccttaaaggggttagaaaacgtaacgaaaacgtaacgttggacgctaacgctaacg

SEQ ID NO: 313187 - DNA, 647 bp, Homo sapiens
  misc_feature: GZ8MTXP01AQRKG.2.57.F02.1.454.CMB.2.raw
  modified_base (202)..(202): a, c, t, g, unknown or other
  misc_feature (202)..(202): n is a, c, g, or t
  modified_base (277)..(277): a, c, t, g, unknown or other
  misc_feature (277)..(277): n is a, c, g, or t
  modified_base (480)..(480): a, c, t, g, unknown or other
  misc_feature (480)..(480): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtagganacagagtcaccatcacttgccgggcagtgagagtgtggtcactattgctggtatcagcaataaaccgaggaaacnccccaagaactcctagactctatgatcgccctcagtcgtgggacggggtcgggtacccccagtcgaaggttcaggtccggacaaggtacgtacgtcgtaggggaactaggaactttccactcctaccaaccaataccaaacgacgcctagccaacgtccgtagtaagttgttacttttacgaaccttaactttaactttaccncgtaaccctaaagtacggttaagttgggttaagtttaaacgttacggtcccgggtagggggttccggtttacccggggaccgggtaaaccgggggtaaccgaaaggggttaacggaaaacgttaacgaaaacggttaactcgggtacgaccgtggaaccctaacccg

SEQ ID NO: 313188 - DNA, 544 bp, Homo sapiens
  misc_feature: GZ8MTXP01CHVWX.2.57.F02.1.454.CMB.2.raw
  modified_base (201)..(201): a, c, t, g, unknown or other
  misc_feature (201)..(201): n is a, c, g, or t
  modified_base (276)..(276): a, c, t, g, unknown or other
  misc_feature (276)..(276): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgtggtcactattgctggtatcagcaataaaccagggaaacnccccagaactcctgatctatgatgcctcagtcgtgggagggtcgggtcccccagtcgaaggttcagcgggcaagtagatcgtgggacagtaactccactctacaccataccaacagccctgccagctgattgtatttgactaactttatactcgaccaagtagtagtagggtagttaattacgtcggtgggttccgttcggacggtaacggggaccttaagggttgaaaacgtaacaaaaacggtctagggtcggactcgccgtaacc

SEQ ID NO: 313189 - DNA, 598 bp, Homo sapiens
  misc_feature: GZ8MTXP01CTBL4.2.57.F02.1.454.CMB.2.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
  modified_base (353)..(353): a, c, t, g, unknown or other
  misc_feature (353)..(353): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgttggtcactatttggcctggtatcagcaataaaccgagggaaacnccccagaactcctgatctatgatcgcctcgagtcgtgggagggtcgggtcccccagtcgaggttcaggccgntaagtagatcgagggacagtacttcacttctacaccataccaaacagcctagcagcctgtattgtattttcgacttaactttatacgtcgacctaagtagttagttggtacgttaatttacggtccgggttcgggttcggtttaccgggccggtaaacgggggtaacccttaaaggggttacggaaaacgttaacccgtaaaaaccgggtaacgttcgggttcggaccgttcgaacccgtaaccc

SEQ ID NO: 313190 - DNA, 540 bp, Homo sapiens
  misc_feature: GZ8MTXP01AOKVE.2.57.F02.1.454.CMB.2.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (352)..(352): a, c, t, g, unknown or other
  misc_feature (352)..(352): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcacatcacttgccggcagtgagngtgtggtcactattggcctggtatcagcaataaaccgngggaaacnccccaagaacctcctgatctatgatgcctccgaggtcgtgggagggtcgggtcccccatcgaaggttcagcggacngtagatcgtgggacagaattcacttcacacatcaaactgcctagcacgcctgatgtatttcgactaattactactgaccaatagtagtggttacgtaaattcggtccggtggggttccgttaccggacggaacggggtaaccaagggttcggaaactccgaaaacgtgtggacggctggaacctaacg

SEQ ID NO: 313191 - DNA, 513 bp, Homo sapiens
  misc_feature: GZ8MTXP01ADUP6.2.57.F02.1.454.CMB.2.raw
  modified_base (201)..(201): a, c, t, g, unknown or other
  misc_feature (201)..(201): n is a, c, g, or t
  modified_base (278)..(278): a, c, t, g, unknown or other
  misc_feature (278)..(278): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgtggtcactattggcctggtatcagcaataaaccagggaaacnccccagaactcctgatctatgatgcctcagtctgggagggtgggtcccccagtcgaaggttcaggcgcaagtagatcgtgggacagaattcactcacaccatcaacagcctgcagcctagatgatttgactaacttatactgaccaatagtagtggtagtaattgtccggtgggttcgttcggcgtaaggggaccaagggttggaaataacgaaacgtctagtgggctgctaacc

SEQ ID NO: 313192 - DNA, 569 bp, Homo sapiens
  misc_feature: GZ8MTXP01DRW3A.2.57.F02.1.454.CMB.2.raw
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (425)..(425): a, c, t, g, unknown or other
  misc_feature (425)..(425): n is a, c, g, or t
  modified_base (452)..(452): a, c, t, g, unknown or other
  misc_feature (452)..(452): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagagacagatcacatcattgccggcagtnagngtgtgcactattggcnggtatcagacaataaaccgaggaaacnccccaagaactccngatctaatgatcgcctcaggttcgtggggacgggtcgggtacccccagtcgaaagggttcaggtccgagaaggtagaacgttcgtagggacaagtaaacttcaactctacaccataccaaacgagcctgacagcctanaatgtatttcgaactaacttattacanaccctaaagtagtagtgtaggttaaacttgtccggtagggttcgttcggcggaaggggtaaccttagggaggttaaactaacgaaaacgtaacgtacggtgacgtcgaacgtaaccg

SEQ ID NO: 313193 - DNA, 579 bp, Homo sapiens
  misc_feature: GZ8MTXP01EOQBI.2.57.F02.1.454.CMB.2.raw
  modified_base (284)..(284): a, c, t, g, unknown or other
  misc_feature (284)..(284): n is a, c, g, or t
  modified_base (364)..(364): a, c, t, g, unknown or other
  misc_feature (364)..(364): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctccccaccctgtctgcatcagtaggagacagagtcaccatcacttgccgggcagtgagagtgttggtcacttattggcctggtatcagcaataaaccgagggaaacnccccaagacctcctgatctatgatcgtccctcgagttcgtggggaggggtcgggtcccccagtcgaaggttcaggccggnaagtagatcgtgggacagattcactctacaccatcaacagcctgcagcctagattgtaattttcgacttaaatttactaccagtacctaaagtagttagtggttaggttaaattcggtccgggtgggttcccggttacgggaccgggaaaggggtaaccgttaagggttacgggaaactaagaaaaccgtaagtgggtacgctaacgccctaacg

SEQ ID NO: 313194 - DNA, 552 bp, Homo sapiens
  misc_feature: GZ8MTXP01D5LMU.2.57.F02.1.454.CMB.2.raw
  modified_base (270)..(270): a, c, t, g, unknown or other
  misc_feature (270)..(270): n is a, c, g, or t
  modified_base (346)..(346): a, c, t, g, unknown or other
  misc_feature (346)..(346): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtagagacagaatcacatcactgccggcagtgagagtgtgtcatattgctgtatcagacaataaaccgaggaacnccccaagactcctagatctatgatcgcctcagtcgtgggagggtcgggtacccccagtacgaaggttcaggccganaaggtagatcgtagggaacagtaattcactctacaacatacaacagcctgcagtcctgtattgtattttcgacttaaatttatactgacctaagagttagtgggttagttaagttcgtccgggtggggttccgttcggaccggaagggggtaaccaaggggttacgaaaataaccgaaaagtcgtggtacggactcgaactaaccg

SEQ ID NO: 313195 - DNA, 672 bp, Homo sapiens
  misc_feature: GZ8MTXP01BKSGO.2.57.F02.1.454.CMB.2.raw
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (313)..(313): a, c, t, g, unknown or other
  misc_feature (313)..(313): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagatcacatcactgccggcagtgagagtgtggtcactgttggctggatcagacaanaaacgaggaacnccccaagacctcngactgtatgattcgcctcaggttcgggnggggtacgggtcggtaccctagtacggtaaggtcgacggaccggtataaggtagtacgtacgggaacggtaactaagtaacttacctacctacctaaccaactacaaccaaccggaccgttccgtacgacgacgtacgtagtagttacgttacgtttacgttaacttaactttaacttacgtaaccgtaacgtaacgttaagttaggttaggttacggttaacgttacggttcgggttcggggttaccgggtaccggggttaaccgggtaacggggtaacgggttaaacgggttaacggttaaacgtaaacggtaaacggtaacggtacggtacggttaccgtaacgttaaccgtaacg

SEQ ID NO: 313196 - DNA, 628 bp, Homo sapiens
  misc_feature: GZ8MTXP01A30GF.2.57.F02.1.454.CMB.2.raw
  modified_base (284)..(284): a, c, t, g, unknown or other
  misc_feature (284)..(284): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagagtcaccatcacttgccggcagtgagtagtgtggtacatattggcctggtatcagacaacgtaaaccgagggaaaccnccccaagacctcctagatctatgatcgcctcagttcgtaggggaggggtcggtacccccagtacgtaggtcaggccgatgtagacgtcgtagggaactagtaactttcacgttctaccaacactaccaaacgacgtcctagcctacggctagtattaggttaattttcgaactttaaactttaacttaccgtacaaccgttaaacgaagtttagtacgggttagttaaacgttcggtcgggtacgggttcgggttaccgggaccggtaagggggaaccttaagggttacgaaaactaaccggaaaacgttaacgtgggtacgggttactcggttaacctaaccg

SEQ ID NO: 313197 - DNA, 641 bp, Homo sapiens
  misc_feature: GZ8MTXP01AMFBG.2.57.F02.1.454.CMB.2.raw
  modified_base (200)..(200): a, c, t, g, unknown or other
  misc_feature (200)..(200): n is a, c, g, or t
  modified_base (479)..(479): a, c, t, g, unknown or other
  misc_feature (479)..(479): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtagganacagagtcacatcacttgccggcagtgagagtgttggtcacttattggcctggtatcagcaagtaaaccgagggaaacgcccccaagaactcctgatctatgatcgcctccgagttcgtgggacgggtcggggtcccccagtcgaaggttcaggacggcgtaaggtagagttcgtaggggaacaggtaaacttccgaaccttctaccaaccactaccaacgacgccctagccaacgtcctagtaactggttacttttcgaacttaaactttacgttacncgtaacccgaataaggttgtagggttagttaaacgttcggttccgggttaggggttcccggtttacgggacccggtaacgggggtaaacccttaagggggttacgttaaaacgtaaccggtaaaacggtaacgtgggtcggaccttaacggaacttaacccg

SEQ ID NO: 313198 - DNA, 589 bp, Homo sapiens
  misc_feature: GZ8MTXP01AB5K3.2.57.F02.1.454.CMB.2.raw
  modified_base (199)..(199): a, c, t, g, unknown or other
  misc_feature (199)..(199): n is a, c, g, or t
  modified_base (277)..(277): a, c, t, g, unknown or other
  misc_feature (277)..(277): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtaganacagagtcacatcacttgccggcagtgagagttgtggtcatagttggcctggtatcagcaagtaaaccgagggaaacnccccaagaacctcctagatctatgatcgcctcgagtcgtgggacgggtcgggtccccccagtcgaaaggttcgaggtccgggactaagtagagtcgtagggactagaactttcacttctacaaccatacaaactacgctgacacgtcctaggattgtattttgacttaactttacttacgcacctaatagtagttagggttagttaacgtttacggttcggtcgggttacggttaccgggaccggaacggggtaaccgttaagggttaacgttaaaacgtcgaaaacgtcgtagtaggcctaagcctaaccg

SEQ ID NO: 313199 - DNA, 634 bp, Homo sapiens
  misc_feature: GZ8MTXP01DFCHE.2.57.F02.1.454.CMB.2.raw
  modified_base (203)..(203): a, c, t, g, unknown or other
  misc_feature (203)..(203): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagagtcacatcacgttggccggcagtgagtagtgtggtcacttattggcctgtatcagacaagtaaacgagggaaacnccccaagaacctctagactacgtangatcgacctccgagttcgaggggtagggtcgggtaccccatacgaggttcagcggataaggatagtcgtagggacagtacttcactctacaacatacgaaacacgcctgactacgcctagtattcgttatttttacgaacttaaactttacttaacgtacgaaccaacgttaagttagttagggggttacttaaacgtttcggttcccggggttgggttcccggttacggggaccggttaaacgggggaaccgttaaaaggggttacgaaaaacgttaaccgaaaaacggtcgttagggtcggttaccgtaacgaacccgtaaccg

SEQ ID NO: 313200 - DNA, 534 bp, Homo sapiens
  misc_feature: GZ8MTXP01A94VL.2.57.F02.1.454.CMB.2.raw
  modified_base (201)..(201): a, c, t, g, unknown or other
  misc_feature (201)..(201): n is a, c, g, or t
  modified_base (276)..(276): a, c, t, g, unknown or other
  misc_feature (276)..(276): n is a, c, g, or t
  modified_base (350)..(350): a, c, t, g, unknown or other
  misc_feature (350)..(350): n is a, c, g, or t
  modified_base (425)..(425): a, c, t, g, unknown or other
  misc_feature (425)..(425): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcacatcacttgccgggcagtgagagtgttggtcactattggcctggtatcagcataaaccaggaaacnccccagaactccgtgatctatgatgcctccagtcgtggaggtcgggtcccccatcgaaggttcaggcggcaagngatcgtgggacagaatcactctcacatcaacacgcctagcagcctagatcgtatttacgactaacttattacgtnacctaatagtagtgtacggttaaatggttcggtggcggttcgggccgaagggggaccgaaggttagggaaacttaagaaaaccgngttagggngacgtcgaacgtaacg

SEQ ID NO: 313201 - DNA, 630 bp, Homo sapiens
  misc_feature: GZ8MTXP01D6E54.2.57.F02.1.454.CMB.2.raw
  modified_base (234)..(234): a, c, t, g, unknown or other
  misc_feature (234)..(234): n is a, c, g, or t
  modified_base (255)..(255): a, c, t, g, unknown or other
  misc_feature (255)..(255): n is a, c, g, or t
  modified_base (276)..(276): a, c, t, g, unknown or other
  misc_feature (276)..(276): n is a, c, g, or t
  modified_base (484)..(484): a, c, t, g, unknown or other
  misc_feature (484)..(484): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgaccacccagatcgacccagtcctccctcccaccctgtctgcatcagtagagacagagtcacatcactcgccggcagtgagngtgtgtctatgttgctggtancagacaataaaccgaggaacnccccagaactcctagtatctatgactcgcctcgagtcgtggggacgggtcggtaccccagtacgaggtcacggcgactaaggtagacgtcggtagggaactacgtaactccacttacctaccaacctaataccaaacgtcgtcccgtagacccgtacgacccttaggtaacttcgttaacgtttacgaactttaaactttacgtaacnccgtaacctaaagttaggttagttagggttaacgttacgtttcgggtccgggttggggttacccggtaccgggacgggtaacggggtaacttaaggggttaacaaacgttaacggaaaccgtaagtcggtcgactcgaacctaacg

SEQ ID NO: 313202 - DNA, 626 bp, Homo sapiens
  misc_feature: GZ8MTXP01BT1UW.2.57.F02.1.454.CMB.2.raw
  modified_base (279)..(279): a, c, t, g, unknown or other
  misc_feature (279)..(279): n is a, c, g, or t
  modified_base (359)..(359): a, c, t, g, unknown or other
  misc_feature (359)..(359): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtagagacagagtcaccatcacttgccggcagtgagagtgtggtcatagttggcctggtatcagcaataaaccgagggaaaccncccaagacctctagatctatgactcgcctacgagtcgtagggacggggtcggtaccccagtacgtaaggtcaggcggacnggtagatcggaggaactagtactcactacacacatacaacgacgcctgacagtcgtagtacttagttacgtttacgaactttaaacttacttaccgacgtaaccgtaaagtacggttaagtaggggttaacgttaacgttcggtcggggttcgggttaccgggttaccgggaccgggtaaacggggtaaaccgttaaaggggttaaacgttaaaacgtaaccggtaaaacggtcgttacgggtcgttaccgttccggaacctaaccg

SEQ ID NO: 313203 - DNA, 676 bp, Homo sapiens
  misc_feature: GZ8MTXP01EXZGK.2.57.F02.1.454.CMB.2.raw
  modified_base (278)..(278): a, c, t, g, unknown or other
  misc_feature (278)..(278): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcaggtaggagacagacgtcacatcacttgccggcagtgagtgtgtgcactagttgctgtatcagacaataaaccgaggaaacnccccaagacctctgtactcgtatgatcgcctcgagtcgtggggagggtcggtaccccagtacgaaggtcaggcgactaaggtagagtcgtagggactagtacttcactcacaacatacaaacgtcgccgtgaccgacgtcctaggtattaggttaactttttcggaacctttaaactttacttaaccgtaccggtaaccctaaaaggttaggtttaagttaggggttaaacgtttaactttccggggttcccggggttcgggggttacccggttaccggggacccgggtaaacggggggtaaaaccgttaaagggggttaaacgggaaaaacccttaacgggaaaaacccggttaacggttacgggtacgggttacctaaccgggttaaccctaaccg

SEQ ID NO: 313204 - DNA, 569 bp, Homo sapiens
  misc_feature: GZ8MTXP01A8MJF.2.57.F02.1.454.CMB.2.raw
  modified_base (231)..(231): a, c, t, g, unknown or other
  misc_feature (231)..(231): n is a, c, g, or t
  modified_base (275)..(275): a, c, t, g, unknown or other
  misc_feature (275)..(275): n is a, c, g, or t
  modified_base (394)..(394): a, c, t, g, unknown or other
  misc_feature (394)..(394): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagatcacatcacttgccgggcagtgagngtgttgtcactattggctggtatcagcaataaaccgaggaaacnccccagaactcctagatctatgatcgcctcagtcgtgggaggtcggtccccagtcgaaggtcagcggacaaggtagacgtcgtagggaacagtacttcactctacaaccataccaaacncgcctgcacgctgattgtattttagacttaaactttatacctgaacctaaagtagttagtagggttagttaaacttcgtccgggtgggttccgttaccgggaccggtaaggggtaaccttaaaggggttcgaaaactaaccgaaaacgtcgtggcggttacctaacgcctaaccg

SEQ ID NO: 313205 - DNA, 560 bp, Homo sapiens
  misc_feature: GZ8MTXP01DL4YE.2.57.F02.1.454.CMB.2.raw
  modified_base (201)..(201): a, c, t, g, unknown or other
  misc_feature (201)..(201): n is a, c, g, or t
  modified_base (283)..(283): a, c, t, g, unknown or other
  misc_feature (283)..(283): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgttggtcacttatttggcctggtatcagacaagtaaaccgaggaaacnccccagaacctcctagactctatgatcgcctccagtcgtgggacgggtcgggtacccccagtacgaaggttcaggcgacaaggtagatcgtagggacaggtactcactctacacatacaacacgcctagacagcctagagttgtaattttcgaacttaactttatacacgaccaaagtagtagtagggtacgttaaatcgtaaccgggtggttcgttcggacggaagggtaaccaagggagaaaactccgaaagtaagtggacgttctcgcctaacg

SEQ ID NO: 313206 - DNA, 697 bp, Homo sapiens
  misc_feature: GZ8MTXP01BOTW6.2.57.F02.1.454.CMB.2.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
  modified_base (364)..(364): a, c, t, g, unknown or other
  misc_feature (364)..(364): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccacctgtctgcatcagtagganacagagtcaccatcacttgccggcagtgagagtgtggtcacttattggcctggtatcagacaagtaaaccgagggaaacnccccaagaacctcctagactctatgatcgcctcgagttcgtgggacgggtcgggtaccccagtcgtaaggtcaggaccggganaaggtagagtcgtagggaactagtaacttccacttctaccaacctataccaaacgtacgtccctagaccgtacgtccgttagtaacgtttggttaaacttttttacggaacctttaaaaccgttttattaacccgttacggaaaccccttaaaggttaaacgggtttagttaccgggggttaaggtttaaaactttcccgggtaacccggggtttagggggttacccggtttaccggggaaccggtaaacggggggtaaaccttaaagggggttacgaaaacgttaaccgaaaaccggtaagtcgggtcggttacttaaccggaacctaaccg

SEQ ID NO: 313207 - DNA, 704 bp, Homo sapiens
  misc_feature: GZ8MTXP01DD24N.2.57.F02.1.454.CMB.2.raw
  modified_base (199)..(199): a, c, t, g, unknown or other
  misc_feature (199)..(199): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacaccagatgacccagtctcctccaccctgtctgcatcagtagganacagagtcaccatcacttgccggcagtgagagtgtgtcactgttggctggtatcagcaataaaccgaggaaacgccccaagactctgactctatgatcgcctccgaggtcgtaggggacgggtcggggtaccccccagtacgtaaagggttcaacggtccggataaggtaagtacgtacggtacggggaactaagggtaaactttccaaccttcaaccaaccactaccgaaaccgtacgtcccgtgacccaagtcccgtagtaacgttaggttacttttacggtaaaccttaaactttaacttaccgttaacgaacccgtaaagttaaggttacgttagggtttaacggttaaacttttaccgggttaaccgggttcgggggttacccggtttaacggggacccggtaaacggggggtaaacccttaaagggggttacgggttaaaaaacttccggaaaaaacggttaaccgttggggtacggttacgttccgaaccgtaacccg

SEQ ID NO: 313208 - DNA, 523 bp, Homo sapiens
  misc_feature: GZ8MTXP01DZAJ6.2.57.F02.1.454.CMB.2.raw
  modified_base (350)..(350): a, c, t, g, unknown or other
  misc_feature (350)..(350): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (410)..(410): a, c, t, g, unknown or other
  misc_feature (410)..(410): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctccaccctgtctgcatcagtagagacagagtcaccatcacttgccgggcagtgagagtgtggtcactattggctggtatcagcaataaaccagggaaacgccccaagaaactcctgatcgtaatgatcgcctccagtctggagggtgggtccccccatcgaaaggttcagcggangtgatgaggacagtatcactcacacanacaacngctgcagcagtatgtattgactaattntacgcgactaagagtgtaggtagtattcgtcggtgggttcgtacggaccggaagggtaaccgaaggttaggaaactaacgaaaccggtaacgtgacgttcgtcgaacctaacg

SEQ ID NO: 313209 - DNA, 592 bp, Homo sapiens
  misc_feature: GZ8MTXP01AQ562.2.57.F02.1.454.CMB.2.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (274)..(274): a, c, t, g, unknown or other
  misc_feature (274)..(274): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcacatcacttgccggcagtgagngtgtgtcatagttggctgtatcagcaataaaccgagggaaacnccccaagaacctctagatctatgatcgcctcgagtcgtgggacggggtcggtcccccagtcgaaggttcaggcggactaaggtacgagtcgtagggaactagtacttccgactctacaacctataaccaactacgcctagaccacgtcctagtagttgttaactttcgaaccttaaactttacgttacacgaccgtaagtagtagttggtagttaagttacgtcggtcgggttcgttcgggacggtaacggggaccgttaagggttacgttaaacgtaacgtaaaccggtaagttgggacggttcgtcggcctaaccg

SEQ ID NO: 313210 - DNA, 625 bp, Homo sapiens
  misc_feature: GZ8MTXP01B7UL4.2.57.F02.1.454.CMB.2.raw
  modified_base (283)..(283): a, c, t, g, unknown or other
  misc_feature (283)..(283): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtaggagacagagtcaccatcacttgccgggcagtgagagtgtggtcacttagttggcctggtatcagacaataaaccgagggaaacnccccaagaactcctgatctatgatcgcctcgagtcgtggggacggggtcgggtcccccagtacgaaggttccaggacggacaaggtagacgtcggtaggggactaagtaacttcactctacacatacaacacgcctgacacgcctagtacttgttacgttttgaccttaaactttacttaacgcgtaaccctaaggtaaggttagtgggttaagttaaacgtttcggtcccgggttggggttccggttaccgggaccggtaaagggggtaacccgttaaagggttacggttaaaactaaccgaaaaccggtcgttcggtacggactaacggaacctaacccg

SEQ ID NO: 313211 - DNA, 704 bp, Homo sapiens
  misc_feature: GZ8MTXP01B3X4Q.2.57.F02.1.454.CMB.2.raw
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (272)..(272): a, c, t, g, unknown or other
  misc_feature (272)..(272): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtaggagacagagtcacatcacttgccggcagtgagngtgtgtcatnttgctgtatcagacataaaccgaggaacnccccagacctcctgatctatgatcgcctcgagtcgtggggacggggtcgggtacccccaggtacgaacggttcaggccggacgtaagggtacgtaagttccgggtagggaaccgtaagtaacttcctaaccgtttccctacccgtaaccctaaagttacccaaacgtaaccgtccccttaggccctacgggacccttggtattaacggtttatttttacgaaactttaaaccttttaacgttaaccgtacgtaaccctaaaacggtgtttaacgggttagggtttaacgggtttaaacttcgggtttaacccggggtggggttcccggttaccggggacggtaaacgggggtaaccgttaaaaggggttcggttaaaacgtaacccgtaaaaccggtcggttggtacggttccgtaacgttcccgttaaccg

SEQ ID NO: 313212 - DNA, 633 bp, Homo sapiens
  misc_feature: GZ8MTXP01CGGOH.2.57.F02.1.454.CMB.2.raw
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (274)..(274): a, c, t, g, unknown or other
  misc_feature (274)..(274): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtctccctccaccctgtctgcatcagtagagacagagtcacatcacgttgccggcaggtgagngtgtgtcatnttggctgtatcagcaataaacgagggaaacnccccaagaactccagactactatgatcgcctcgagttcgtggggacgggtcgggtcccccagtcgtaaggttcaacggcggacaaggttagacgttcggtagggaactagtaaacttccactctacactactacaacagtccctagaccacggtcctagtactttgttaacgttttacgaacctttaaaacttacgttaaccacgtaccgtaaagtaggttacgttagggttagttaacgtttaggtccgggttacggggttccggttaccgggacggtaaacgggggtaacgttaaagggttaacggaaaacgtaaccgtaaaaacgtcgtaggtacggttactaaccggaactaacc

SEQ ID NO: 313213 - DNA, 606 bp, Homo sapiens
  misc_feature: GZ8MTXP01EIAVO.2.57.F02.1.454.CMB.2.raw
  modified_base (237)..(237): a, c, t, g, unknown or other
  misc_feature (237)..(237): n is a, c, g, or t
  modified_base (285)..(285): a, c, t, g, unknown or other
  misc_feature (285)..(285): n is a, c, g, or t
  modified_base (357)..(357): a, c, t, g, unknown or other
  misc_feature (357)..(357): n is a, c, g, or t
tcagacgctcgacacacgaccggtgctcgatttagctcgatatagttggggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcagtaggagacagagtcaccatcacttgccgggcagtgagngttgtggtcacttagttggctggtatcagacaataaaccgaggaaacnccccaagacctcagatctatgatcgcctcgagtcgtgggacgggtcggtccccagtcgaaggtcaggacggnaaggtagatcgtgggaacagtaacttcactcacacatacaacacgcctagccgagcctagaacttgtaacttttcgacttaacttacttacacgaccctaataggttaagtgggttaagttacgttacggtccggggtaggggttcccggtttcgggaaccggtaacgggggaaccgttaaagggggttaacgaaaacgttaaccggaaaacggtaacgttcggggtacgacgtttaacgccgtaaccg

SEQ ID NO: 313214 - DNA, 617 bp, Homo sapiens
  misc_feature: GZ8MTXP01EC81J.2.57.F02.1.454.CMB.2.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcagtagganacagagtcaccatcacgttcggccgggcaggtgaggtagttgttggtctacgttagttcggcctaggtatcgagacaaagtaaaccgagggaaacnccccaagaacctcctagatctatgactcgcctcgagtcgnggggacgggtcggtaccccagtacgtaaggtcgacggcggataaggtagacgtcggtagggaactagtaacttcactcacaccatacaacacgcctagcacgtctagtattgttatttacgaacttaaacttctacgcgaacctaaagtaggttagtagggttagttaaacttcgggtccgggttgggttaccggttccgggaacggaaagggggtaaccttaaaggggttacaaaacgtaacgaaacgtcgttggacggttcaacgttaactaacg

SEQ ID NO: 313215 - DNA, 586 bp, Homo sapiens
  misc_feature: GZ8MTXP01E3R8B.2.57.F02.1.454.CMB.2.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (386)..(386): a, c, t, g, unknown or other
  misc_feature (386)..(386): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcaggtagganacagagtcacatcacttggccgggcagtgagngtgtgcatattggcnggtatnagacaataaacgaggaaacnccccagaactcngatntangatcgctccgagtcgngggagggtcggccccagtcgaaggtcaggcganaaggtanagtcgtaggaacagtaactcactacacaacctaanacacgacgcctagaccagtctagtacttgtttaacgtttacgaaacctttaacttacgtactacgaaccttaaagtaggttagtagggttagttaacgttcgggtccggggttcgggttaccggtacggggacggtaacggggaacgaaggggttaagaaactaacggtaaagtcggtggtcgttacgtaacgccgtaac

SEQ ID NO: 313216 - DNA, 648 bp, Homo sapiens
  misc_feature: GZ8MTXP01EHEVA.2.57.F02.1.454.CMB.2.raw
  modified_base (205)..(205): a, c, t, g, unknown or other
  misc_feature (205)..(205): n is a, c, g, or t
  modified_base (282)..(282): a, c, t, g, unknown or other
  misc_feature (282)..(282): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgaccacccagatcgacccagtcctccctcccaccctgtctgcatcagtagganacagagtcaccatcacttgccgggcagtgagagtgtgtcatgttggctggtatcagacaagtaaaccgagggaaacnccccaagacctcctagatactatgatcgcctcgaggtcgtaggggcgggtcggtacccccagtacgaaggtcgaggccggataaggtacgagtcggtagggaactaggtacttccgacttacaccactactacaacacgtcctgacagtcctagtattgttacgtttacacttaaacttatacgtacgtaacctaagtaggttagttaggggttacgtttaacgttcgggtaaccgggtttgggggttaccccggtttacccggggaacgggtaaacgggggtaacccgttaaaaggggttacggttaaaaacgtaaccggaaaacgtccggttagggtcggttaccttaacggaacccttaaccg

SEQ ID NO: 313217 - DNA, 675 bp, Homo sapiens
  misc_feature: GZ8MTXP01AG2XS.2.57.F02.1.454.CMB.2.raw
  modified_base (291)..(291): a, c, t, g, unknown or other
  misc_feature (291)..(291): n is a, c, g, or t
  modified_base (448)..(448): a, c, t, g, unknown or other
  misc_feature (448)..(448): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtaggagacagagtcacatcactgccggcagtgagtgtgttggtactacttagttggcctggtactcgagacaaacgtaaaccggagggaaaccnccccaagacctccgtagatctatgatcgtccctcgtagtcggtaggggagggtcgggtacccccagtacggtaaggtccgaaggtccgggagtaacggtagtacgttcggtagggaactagtaactttacgaccttacctacaacccataaccaacncgtcccagcctaagcctagtaagtttcgtacttttacgactttaaacgttacttaccgcgtaaccgtaaagtttaaggttagggttacgggttaaacgttaaacgtttccgggtaaccggggttacgggttccggggtacccggttaccggggaaacgggtaaccggttaaaggttaggaaaaccttaaggaaaccgtaagttcggaggttctaacggcccgtaacg

SEQ ID NO: 313218 - DNA, 559 bp, Homo sapiens
  misc_feature: GZ8MTXP01CDACL.2.57.F02.1.454.CMB.2.raw
  modified_base (281)..(281): a, c, t, g, unknown or other
  misc_feature (281)..(281): n is a, c, g, or t
  modified_base (402)..(402): a, c, t, g, unknown or other
  misc_feature (402)..(402): n is a, c, g, or t
  modified_base (456)..(456): a, c, t, g, unknown or other
  misc_feature (456)..(456): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactagtttggcctggtatcagcaataaaccgaggaaacnccccaagaacctcctgactctatgatgcctccagtcgtggagggtcggtcccccagtcgaaggttcaggcggacaagtagagtcgtagggacagtaacttcaactctacaccataccaaancgcctgccagcctgattgtaattttgactaactttagtactgacctaagtagtntagggtagttaaattcgccggttgggccgttaccggacggaaggggtaccttaaaggggttgaaaacttcgaaaacggtaactggtcggctaacggctaaccg

SEQ ID NO: 313219 - DNA, 676 bp, Homo sapiens
  misc_feature: GZ8MTXP01APQW1.2.57.F02.1.454.CMB.2.raw
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcagtaggagacagagtcaccatcacttcgccgggcagtgagagtgttgctacttnttcggctggtatcagcaataaaccgaggaaacnccccaagacctctagactctatcgatcgacctcaggtcgtggggtacggtcgggtacccctagtacgtaaggtcgaggaccgtacgaaggtacgtacgttcgtaaggggtaactaaggtaaacttcccaaccttcctaaccaacctaactaacccaaacgtccggtcccttcggaccacggtacccttagggtacttttacggttaactttttacggaacctttaaacttttacttaccgaacgtaacccgtaaagttaggttacgttagggggttaactttaaacgtttccggtcggggtacgggttcccggtacgggttaccggaaacggggtaaacggttagggttaacaaacgtaagaaaacgtcgtgggacgttactaacgccgtaac

SEQ ID NO: 313220 - DNA, 609 bp, Homo sapiens
  misc_feature: GZ8MTXP01A2VW5.2.57.F02.1.454.CMB.2.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (256)..(257): a, c, t, g, unknown or other
  misc_feature (256)..(257): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
  modified_base (343)..(343): a, c, t, g, unknown or other
  misc_feature (343)..(343): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagagtcacatcacttgccggcagtgagagtgtgtcactnttgctgtancannataaacaggaacncccagactcngatctangatcgcctcagtcgtgggacggggtcgggtcccccagtcgaaggttcacggcgganaaggtagagtcgtaggggactaagtaacttcacttctaccaacatacaacacgccctagccagcctgtattgtacttttcgaccttaactttacttacgtacgaccctaaagtaggtttacgtggggttaaagttaaacttccgggttaacccggggtggggttcccgggttaccgggacccgggaaacgggggtaaccgttaaagggggttacggaaaacttaaccggaaaacggtaagtcgggtacggttctcggccgtaaccg

SEQ ID NO: 313221 - DNA, 603 bp, Homo sapiens
  misc_feature: GZ8MTXP01D60R4.2.57.F02.1.454.CMB.2.raw
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (359)..(359): a, c, t, g, unknown or other
  misc_feature (359)..(359): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcagtaggagacagatcaccatcacttgccgggcagtgagngtgtgtcntattggctgtatcagacaagtaaaccgaggaaacgccccaagaacctcctagatctatgatcgcctcgagtcgtgggagggtcgggtcccccagtcgaaggtcaggcgcaagtagngtcgtagggacagtatcacctctacaacataccaacgacgcctgacctagccgttagattcgttagttttacgaacctttaaacttactacgtacgaacctaaagttaggttaagtgggttaaagttaacttcggtcccggggttgggttccggttcgggaccggtaacggggaaccgttaaggggttagaaaacgtccgtaaaaaccggtgttcggacggttaccgttcggaacccgtaaccg

SEQ ID NO: 313222 - DNA, 608 bp, Homo sapiens
  misc_feature: GZ8MTXP01E0YMI.2.57.F02.1.454.CMB.2.raw
  modified_base (298)..(298): a, c, t, g, unknown or other
  misc_feature (298)..(298): n is a, c, g, or t
  modified_base (571)..(571): a, c, t, g, unknown or other
  misc_feature (571)..(571): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtaggagacagagtcaccatcacgttcgccgggcagtgagtagttgttggtctacttagtttcggctggtactcgagacaaacgtaaaccgaggggaaaccncccctaagaacctcctagactctatgactcgcctcgagtcgtggggacgggtcgggtacccccagtacgaaagggttcgaggcgtacgtaaggttagacgttcggtaggggaactaaggtaactttccaacttcaccaacataaccaactacgcctagcctagcctaggacttgttagtttcaacttaacgtttataccacgacctaagtaggtagtggttagttattggtcgggttggttaccggttcggacggaagggtaacaagggttanaaacgtaacgaaacgtaagtcggtgactcgctaaccg

SEQ ID NO: 313223 - DNA, 599 bp, Homo sapiens
  misc_feature: GZ8MTXP01E0MXT.2.57.F02.1.454.CMB.2.raw
  modified_base (202)..(202): a, c, t, g, unknown or other
  misc_feature (202)..(202): n is a, c, g, or t
  modified_base (283)..(283): a, c, t, g, unknown or other
  misc_feature (283)..(283): n is a, c, g, or t
  modified_base (370)..(370): a, c, t, g, unknown or other
  misc_feature (370)..(370): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtagganacagagtcaccatcacttgccgggcagtgagagtgttggtcactagttcggctggtatcagcaagtaaaccgagggaaacnccccagaacctcctagatctatgatcgcctcgagtcgtgggacgggtcgggtcccccagtcgaaggttcacggcggactaaggtagngtcgtaggggactaaggtaacttcactctacacatacaacacgcctagcagcctgtacttgttattttcgacttaaactttatacctcgacctaaagtagttagtgggttaagttaacttggtccgggttggggttccggttaccgggaccggtaaacggggtaacccgttaaaggggttcgaaaacgttaaccgaaaacggtaacgtcggtaggactcgccgtaaccg

SEQ ID NO: 313224 - DNA, 633 bp, Homo sapiens
  misc_feature: GZ8MTXP01ERNK0.2.57.F02.1.454.CMB.2.raw
  modified_base (281)..(281): a, c, t, g, unknown or other
  misc_feature (281)..(281): n is a, c, g, or t
  modified_base (367)..(367): a, c, t, g, unknown or other
  misc_feature (367)..(367): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagagacagagtcaccatcacttgccggcagtgagtgtgttggtcatagttggcctggtatcagacaagtaaaccgagggaaacnccccaagaacctcctagactctatgatcgcctcagttcgtggacgggtcgggtcccccagtacgaaggttcaggcggacaaggtanagtcgtagggactagtaacttcgaactctacaaccatacaacacgtcctacgcaagcctaggtacttgtacgttttagacctaaactttacgttaccgtgaaccctaagtaagttacgttagggttaacgttaaagttccgtcccggggttgggttacccggttacggttacccggaaagggggtaacccgttaaagggttacggttaaaaccgttaacgaaaaccggtaacgttacgggtacggttacttaaccggcttaacccg

SEQ ID NO: 313225 - DNA, 706 bp, Homo sapiens
  misc_feature: GZ8MTXP01EXQRP.2.57.F02.1.454.CMB.2.raw
  modified_base (203)..(203): a, c, t, g, unknown or other
  misc_feature (203)..(203): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagagtccaccatcacttgccggcagtgagagtgtgcactagttggctggtatcagacaataaaccgagggaaacccccaagacctcctgatctatgatcgcctcgagtcgtggggagggtcggtacccccagtcgaaggtcaggcgacaaggtagactcggtagggaactagtacttccacttcacaccatccaacgacgtcctagacctaacggcccttaggtaactttacgggtttaactttttaccggaaacctttaaaaccttttcgtttaaacccgaccgtaaacccgttaaagtagggtttaacggttacggggtttaaagtttaaacggtttccggggtcccgggggtttacgggggttacccgggtttaccggggaaacccgggaaaggggggttaaaccccgttaaaagggggtttaccggaaaaacgtttaacccggaaaaacgggtttccggtggggtaccgggttaccttcgggttaacccttaacccg

SEQ ID NO: 313226 - DNA, 553 bp, Homo sapiens
  misc_feature: GZ8MTXP01DYKZF.2.57.F02.1.454.CMB.2.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (278)..(278): a, c, t, g, unknown or other
  misc_feature (278)..(278): n is a, c, g, or t
  modified_base (437)..(437): a, c, t, g, unknown or other
  misc_feature (437)..(437): n is a, c, g, or t
  modified_base (534)..(534): a, c, t, g, unknown or other
  misc_feature (534)..(534): n is a, c, g, or t
tcagacgctcgacacacgaccggtgctcgatttagctcgatatagtttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtagganacagagtcaccatcacttgcggcagtgagngtgtgtcactattggctggtatcagacaataaaccgagggaaacnccccaaagactcctagatctatgatcgcctccagtcgtggggacggtcggtcccccagtcgaaggttcaggcggacaagttagagtcgtagggactagtactcactctacacatacaacacgcctagcagtctagtattgtatttcgacttaactttanctacgacctaagtagttagtggttagttacttggaacggttgggttccgttacgggcggtaacgggacgttaaggttcgaaactaacgaacgtaagnggtacgcaacggttctaac

SEQ ID NO: 313227 - DNA, 753 bp, Homo sapiens
  misc_feature: GZ8MTXP01AH1PM.2.57.F02.1.454.CMB.2.raw
  modified_base (205)..(205): a, c, t, g, unknown or other
  misc_feature (205)..(205): n is a, c, g, or t
  modified_base (286)..(286): a, c, t, g, unknown or other
  misc_feature (286)..(286): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgaccacccagatgacccagtcctccctcccaccctgtctgcatcaggtagganacagagtcacatcactgccggcagtgagtgtgtggtctacttagttcggctggtatcagacaacgtaaaccgaggaaaccnccccaagtaacctccgtagactctagtgactcgcctccgaggttcggtagggggtacgggtccggggtacccccaggttcgaaagggttcgaggtacggactaaggtagtacgttcgggtaggggaactaggttaaaccttccgaaccttctacccaaacctagtaaccaaacgtaccgtcctacggcctaacggttccgtaagtatttacggtttaacttttacggaaacctttaaactttaaccgtttaccgaacgtacccgttaaaaggttaggtttaacgggttacgggttaaacggttttaaactttccggggttaacccgggggttcggggttacccgggtttaacccgggacggggtaaacgggggtaaaacccgttaagggggttaaacgttaaaaccggttaaaccggaaacccggttaaggttcgggtcggttacctaacgggttaacccttaaccg

SEQ ID NO: 313228 - DNA, 615 bp, Homo sapiens
  misc_feature: GZ8MTXP01DSUZZ.2.57.F02.1.454.CMB.2.raw
  modified_base (247)..(247): a, c, t, g, unknown or other
  misc_feature (247)..(247): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgaccacccagatgacccagtcctccctcccaccctgtctgcatcagtaggagacagagtcaccatcacttgccgggcagtgagagtgttgtcatnttggctggtatcagacaagtaaaccgagggaaacccccaagaactcctagatctatgatcgcctcgagtcgtgggaggggtcggtcccccagtcgaaggttcaggtccggataaggtagtacgtcggtagggaactagtaattccactctaccacataccaactacgcctagcagcctagtattagttattttacgacttaaactttacgttactacgacctaaagtaggttgttagggttacgtaaagttcggttccgggtggggttcggttaccgggaccggaaacgggggtaaccgaaaggggttagaaaaacgttaaccggaaaaaccggtcgttagggtacggttaccgtgaacccgtaaccg

SEQ ID NO: 313229 - DNA, 551 bp, Homo sapiens
  misc_feature: GZ8MTXP01EHVLA.2.57.F02.1.454.CMB.2.raw
  modified_base (278)..(278): a, c, t, g, unknown or other
  misc_feature (278)..(278): n is a, c, g, or t
  modified_base (443)..(443): a, c, t, g, unknown or other
  misc_feature (443)..(443): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcaataaaccagggaaacnccccaagaactctgatctatgatgcctccagtcgtgggagggtcgggtcccccatcgaaggttcaggccggatggtagattcgtaggggaacagtaaattcactctacaccatacaacagcctgcagcctgattgtattttgactaactttagtactgacctaanagttagtggttaggttaattaggtccggttggggttcgttcgggaccgaggggaaccgttagggttacgaaagtcgaaaacgtaacgtgacggactcgaacgtaaccg

SEQ ID NO: 313230 - DNA, 614 bp, Homo sapiens
  misc_feature: GZ8MTXP01BH5H9.2.57.F02.1.454.CMB.2.raw
  modified_base (280)..(280): a, c, t, g, unknown or other
  misc_feature (280)..(280): n is a, c, g, or t
  modified_base (321)..(321): a, c, t, g, unknown or other
  misc_feature (321)..(321): n is a, c, g, or t
  modified_base (356)..(356): a, c, t, g, unknown or other
  misc_feature (356)..(356): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccacctgtctgcatcagtaggagacagagtcacatcacttgccggcagtgagagttgtggtcactattggctggtatcagacaacgtaaaccgagggaaacnccccgaagaacctcctagatctatgatcgcctccgagtcgngggagggtcggtaccccagtcgaaggtcaggcgangtagatgtgggacagaacttcactctacacatacaacacgcctgcagcctgacttgttagtttagacttaaactttacttaaccgtcgtaaccctaagtacggttaagttaggggttacgttaaacgtttcgtaaccggggttggggttccggttaccggggaccgggtaaacgggggaaccgttaaagggggttaacggaaaaccgttaaccggtaaaacggtaacgttcgggtaggttaccgtcgaacctaacccg

SEQ ID NO: 313231 - DNA, 717 bp, Homo sapiens
  misc_feature: GZ8MTXP01AWZAB.2.57.F02.1.454.CMB.2.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (514)..(514): a, c, t, g, unknown or other
  misc_feature (514)..(514): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcagtaganacagacgtcacatcacgttgccggcagtgagtagttgtggtctattgttggcctggtactcgagacaacgtaaaccgagggtaaaccncccccaaagtaacccttccgtagtaacttaccgtaagtcgtaacgttcccgtccccgttaccgaggttcccgggttagggggtaccgggggtttaccgggttacccccccaaggttacggtaacgggtttccgagggtaacccgggtactaagggtacgtacgttcggtaagggactagtaacttccacgtctaccacatacacgacgtctagcacgtctagnttacgttacgtttacgaacttaactttacgttacacgtaacgtacgttaggttacgttagggttaccgtttaattccggggtcgggttcgggttaccggttccggggaaccgggtaacgggggtaaaccgttaacggggttaaacgaaccttaaacggtaaaccggtaacggttcggaccggttacttaaccgccgttaaccg

SEQ ID NO: 313232 - DNA, 615 bp, Homo sapiens
  misc_feature: GZ8MTXP01D6VMB.2.57.F02.1.454.CMB.2.raw
  modified_base (205)..(205): a, c, t, g, unknown or other
  misc_feature (205)..(205): n is a, c, g, or t
  modified_base (293)..(293): a, c, t, g, unknown or other
  misc_feature (293)..(293): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgaccacccagatcgacccagtcctccctcccaccctgtctgcatcagtagganacagacgtcaccatcacgttggcccgggcagtgaggtagttgtggtctacttgttggctggatcagacaacgaaaccgagggaaaccnccccaagaacctctagacttactatgtatccgcctcgagttcgtaggggaggggtccggtaccccagtcgaaggttcaggcggataaggtagagttcgagggacagtacttcactcacacataccaaagcgtctagcagctagattacgtttatttacgacttaaacttactcacgaactaaagtaggttagtggggtttaacttaacgttcgggtccgggttgggttacccggttaccgggacggtaaacgggggtaaccttaaaggggttaaccttaaacgaaccgtaaagtcgtggtacgttactaaccgaacgtaacc

SEQ ID NO: 313233 - DNA, 555 bp, Homo sapiens
  misc_feature: GZ8MTXP01DP66M.2.57.F02.1.454.CMB.2.raw
  modified_base (279)..(279): a, c, t, g, unknown or other
  misc_feature (279)..(279): n is a, c, g, or t
  modified_base (357)..(357): a, c, t, g, unknown or other
  misc_feature (357)..(357): n is a, c, g, or t
  modified_base (400)..(400): a, c, t, g, unknown or other
  misc_feature (400)..(400): n is a, c, g, or t
  modified_base (444)..(444): a, c, t, g, unknown or other
  misc_feature (444)..(444): n is a, c, g, or t
  modified_base (544)..(544): a, c, t, g, unknown or other
  misc_feature (544)..(544): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcacatcacttgccggcagtgagagtgttggtcactattggcctggtatcagacaataaaccgagggaaacnccccaagaacctcctagatctatgatcgcctcagttcgtgggaggggtcgggtcccccagtcgaaggttcaggccggntaagtagagtcgtaggggacagtactcactctacacatccaanacgcctgccagcctgtatcgttaagtttcgacttaacttatacncgaaccaagtagtacgtggtagtaacttcgtccgggtagggttcgttccgggaccgtaagggggtaccttaaagggttgaaactaaccgaaagtcgtggngctcgctaacc

SEQ ID NO: 313234 - DNA, 612 bp, Homo sapiens
  misc_feature: GZ8MTXP01C56GJ.2.57.F02.1.454.CMB.2.raw
  modified_base (204)..(204): a, c, t, g, unknown or other
  misc_feature (204)..(204): n is a, c, g, or t
  modified_base (287)..(287): a, c, t, g, unknown or other
  misc_feature (287)..(287): n is a, c, g, or t
  modified_base (332)..(332): a, c, t, g, unknown or other
  misc_feature (332)..(332): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgaccaaatgtgacacccagatgacccagtcctccctcccaccctgtctgcatcagtagganacagatcaccatcactggccggcagtgagtagtgttggtctacttagttggcctggtatcagacaagtaaaccgagggaaacnccccaagacctcctgactctatgactcgcctcgagtcggtggggnggggtcgggtcccccagtacgaaggtcgacggcggacgaaggtagtacgtcggtaggggactaaggtaacttccgaccttcctaccaacctaataccgaaacgacgtccctgacctacgtccttagtacttggttacttttacgaacttaaactttactaccacgacctaagtagttagttagggttagttaattcggtccgggtgggttaccggtcggacgggtaaggggaacttaagggttagaaactaaccgaaacgtcgtggcgctcgaacctaac

SEQ ID NO: 313235 - DNA, 668 bp, Homo sapiens
  misc_feature: GZ8MTXP01B6LSK.2.57.F02.1.454.CMB.2.raw
  modified_base (203)..(203): a, c, t, g, unknown or other
  misc_feature (203)..(203): n is a, c, g, or t
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagagtcacatcacttgccgggcagtgagagttgttggtcacttagttggcctggtatcagacaataaaccgaggaaacnccccaagacctcctgatctangatcgcctacgaggtcgtggggacggggtcggtacccccagtacgtaaggttcaggcgggacaaggtacgagtcggtagggactaagtaacttccacttcacaaccataccaaacgcgtcctgacgacgcttaggatttcgttaagtttttcaacctttaaactttacgtaccgtcgaaccctaaagtaggtttagtacgggttaaagtttaaacttccgggttcccgggtggggttacccggtttaccggggaaacccgggtaaacgggggtaacccttaaaaggggggtttacgaaaaaacgttcccggaaaaaacggttcgtttcggggacgttacccgtaacgttaaccccgtaaaccg

SEQ ID NO: 313236 - DNA, 698 bp, Homo sapiens
  misc_feature: GZ8MTXP01BU67P.2.57.F02.1.454.CMB.2.raw
  modified_base (287)..(287): a, c, t, g, unknown or other
  misc_feature (287)..(287): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtctccctcccaccctgtctgcatcagtaggagacagagtcacatcacgttgccgggcagtgagagttgtggtcagttagttcggctaggtatcatacaagtaaaccaggggaaacnccccaagaacctcctaaggctactatgactcgaccctcgtagttccgtaggggacgggttccgggtccccccaagttcgtaaacgggttcaacgggtccggactaaggtaacgtaacggttccgtaacggggaactaacggtaaactttcccaaacttccctaccaaaccctattaacccgaaaccgtaacggtccccttaggacctacggtaccttaggttaacgtttactttaacgtttacgaacctttaacttacttaaccgaccgtacgtaaagttaggtagttagggttagttaccgttcggtccgggtcgggttccggtaaccgggaccgggtaaacggggtaacgttaacgggttacgaaaacgtaacgaaaccgtaagtcggtacgcgtaacgaaccgtaacg

SEQ ID NO: 313237 - DNA, 609 bp, Homo sapiens
  misc_feature: GZ8MTXP01C653V.2.57.F02.1.454.CMB.2.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (312)..(312): a, c, t, g, unknown or other
  misc_feature (312)..(312): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtagganacagatcaccatcacttgccgggcagtgagtagttgttggtctacgttagttcggcctggtatcagacaagtaaacccgagggaaacnccccaagaactcctgactctangatcgcctacgagtcgagggagggtcgggtaccccccagtacgaggttcgagtcgggactggtaagacgtacggtacgggactaagtaactccaactcctaccaacctatacccgaaacacgtctagaccacgtctagattcgttattttcgaacttaattactcctagacctaagtagtagtggtacgtaagttcggtaaccggtgggccgttacggaccgggtaaggggtaccgaaaagggttcgaaaacgtaaccgaaaagtccgttggacggttctaacgttaaccgtaaccg

SEQ ID NO: 313238 - DNA, 668 bp, Homo sapiens
  misc_feature: GZ8MTXP01ASJBK.2.57.F02.1.454.CMB.2.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccacctgtctgcatcagtagganacagagtcaccatcacgtgccggcagtgagagtgtgtcatnttgctgtancagcaataaaccgnggaacnccccagactcngactntatnatcgcctcgagttcgtgggtacggggtcggtacccccagtacgtaggttccaggccgggacaaggttagacgtcgtaggggacaaggtattccacttcacacctactaccaactaggcccctagccgacgtaccgtaggtaatttcggtaactttttacggaacctttaacctttaacttttaacccgaaccggacccttaaaaggtaggtttaacgttacggggtttaaggtttaaacgtttcggtccgggggttcggggttacccgggtttaccgggaccgggttaaaccggggggtaacccttaagggggttaaacttaaaccggaaacccggtaaaggttaaccgtgggttcgggactccggcctaaccgg

SEQ ID NO: 313239 - DNA, 596 bp, Homo sapiens
  misc_feature: GZ8MTXP01DIQBV.2.57.F02.1.454.CMB.2.raw
  modified_base (254)..(254): a, c, t, g, unknown or other
  misc_feature (254)..(254): n is a, c, g, or t
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (357)..(357): a, c, t, g, unknown or other
  misc_feature (357)..(357): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcatattgctggtancagacaataaaccgaggaaacncccccaagaacctcctagactcgtangatcgcctcgagtcgtgggagggtcgggtcccccagtcgaaggttcaggaccganaaggtagatcgtagggacagtacttcactcacacatacgaacagcctgacacgctgattgtattttcgactaaactttatacctgacctaaagacgttagtcgggttagttaaacttcggttaaccggtcgggggttcgttaccgggaccggtaaacgggggtaaccgttaaaggggttacgttaaaaacgttaaccgaaaaccgttaagttcgggtacggacttccgaacgtaacccg

SEQ ID NO: 313240 - DNA, 608 bp, Homo sapiens
  misc_feature: GZ8MTXP01CM69S.2.57.F02.1.454.CMB.2.raw
  modified_base (284)..(284): a, c, t, g, unknown or other
  misc_feature (284)..(284): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagacgctcgacacacgaccggtgctcgatttagctcgatatagttgggtttgggggcaggcgtcagactcagtcaggacacagcatggacatggagggtccccgctcagctcctggggctcctgctgctctggctcccaggtgccaaatgtgacacccagatgacccagtcctcctcccaccctgtctgcatcagtaggagacagagtcaccatcacttgccgggcagtgagagtgttggtcactagttggcctggtatccagcaataaaccgagggaaacnccccagaactcctgactctatgactgcctcgagtcgtggggagggtcggggtacccccagtcgaaaggttcaggaccgggacaaggtagtacgtcgtaggggacaggtaaacttcaactctacacataccaaacgcgactgcgaacncctagntagttatttcgaccttaattataccgtgaacctaagtaagtgtggttagtaactttagcccgggttaagggttcggttaccggaccggtaaaggggaacccgttaagggacggttaaaacgtaaccgaaaaacggtttaacgacggttcggacgttcgaaccgtaaacccg

SEQ ID NO: 313241 - DNA, 797 bp, Homo sapiens
  misc_feature: GZ8MTXP01EBID3.2.57.F02.1.454.CMB.2.raw
  modified_base (294)..(294): a, c, t, g, unknown or other
  misc_feature (294)..(294): n is a, c, g, or t
  modified_base (420)..(420): a, c, t, g, unknown or other
  misc_feature (420)..(420): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcagtaggagacagagtccacatcacgttggccgggcagtgagtagttgtggtctacttagttcggctggtatcgagacaacgtaaaccgagggaaaccnccccaagaacctcctagtacttctaataggacttccgacccttccgtaggttccggtagggggtacggggtcggggtacccccccagtacggtaacggttcgacgggaaccggtactaagggttanacgttacgggtacgggaacgtaacgtaactttcccacttcctaccaaccctaatacccaaacgccggtccctacggacccgtacgtcccttagtaacgtttggtttaactttttacggtaacctttaaaaccgtttacttaacgtacccggtaaccttaaaagttacgggtttaagttgggggtttaaaccgtttaaaaggttttcccgggttccgggttagggggttaccccgggtttaaccggggaacccggggtaaacggggggttaaacccgttaaaaggggggttaaccggttaaaaacggttaacccgggtaaaaaacgggtaacccggtttggggacccgggttaccttaacccgggaaccttaacccgg

SEQ ID NO: 313242 - DNA, 743 bp, Homo sapiens
  misc_feature: GZ8MTXP01ECPLU.2.57.F02.1.454.CMB.2.raw
  modified_base (278)..(278): a, c, t, g, unknown or other
  misc_feature (278)..(278): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtaggagacagagtcaccatcacttgccggcagtgagagtgtgtcactattggctggtatcagacaataaaccgaggaaacnccccagaactcctgatctatgatcgcctacgagtcgtgggacgggtcgggtcccccagtcgaaggtcacggtcggacaaggttagacgttcgtaggggaacctaggtaactttccacttacctaccaaccaataccaaactacggtccctggacccacggtacccgttaggtaactttacggtttaacgttttttacggaacctttaaaacgttttacttaaaccgttcggaaaccccttaaaggtaaggttttacgttagggggtttaaacggtttaaacttttcggggtccccgggtttagggggttaccccgggtttaccggggttaaaccccggggtaaaggggggttaaaaccccgttaaaagggggtttacgggaaaaaaaccgttaaccccggttaaaaaaccgggtaacgggttaagggtttccgggaccctttaacggttccccggtaaaaccccg

SEQ ID NO: 313243 - DNA, 573 bp, Homo sapiens
  misc_feature: GZ8MTXP01A1G4C.2.57.F02.1.454.CMB.2.raw
  modified_base (203)..(203): a, c, t, g, unknown or other
  misc_feature (203)..(203): n is a, c, g, or t
  modified_base (276)..(276): a, c, t, g, unknown or other
  misc_feature (276)..(276): n is a, c, g, or t
  modified_base (453)..(453): a, c, t, g, unknown or other
  misc_feature (453)..(453): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcagtaganacagagtcaaccatcacttgccggcagtgagagtgtgtctatattgctgtactcagcaataaaccgaggaacnccccaagactctagactctatgatcgcctcagtcgtgggacggggttcggtcccccagtcgaaggttcaggcgacaagtagatacggtaggaactagaaactttcaccttacaccgaactagtacaaacacgtccagcacgtactgtattacgttattcgaacttaacttacttacncgtacaagtagttagttgggtaattaacttcggtcggtcgggttcgtcccgggcggtaaacggggaacttaaggggttacttaaacaacgaaaccgtaacgtggtcgatcgcttaacccg

SEQ ID NO: 313244 - DNA, 675 bp, Homo sapiens
  misc_feature: GZ8MTXP01CYEXH.2.57.F02.1.454.CMB.2.raw
  modified_base (285)..(285): a, c, t, g, unknown or other
  misc_feature (285)..(285): n is a, c, g, or t
  modified_base (441)..(441): a, c, t, g, unknown or other
  misc_feature (441)..(441): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacgttgccgggcagtgagagttgttggtcacttagttggctggtatcagacaagtaaaccgagggaaacnccccaagaacctcctagacttactatgatcgcctacgagttcgtggggacggggtcgggtacccccagtacgaaggttcaaggccggacgtaaggtagacgtcgggtacggggaacagtaaacttccaccttactaccaaacctataacctaaacnccgtacccgtagaccgacgtcctagtattacggttaattttacgactttaaactttactacgtcgaacctaagtaggttacgtagggttagttaaacgttcggtccgggttgggttaccgggtttaccggggaccggtaaacgggggtaacccgttaaagggggttacggttaaaaaccgtaacggtaaaaccgggtcgtttagggacggttacgtaaccgaaccgttaacccg

SEQ ID NO: 313245 - DNA, 553 bp, Homo sapiens
  misc_feature: GZ8MTXP01CSSOD.2.57.F02.1.454.CMB.2.raw
  modified_base (203)..(203): a, c, t, g, unknown or other
  misc_feature (203)..(203): n is a, c, g, or t
  modified_base (280)..(280): a, c, t, g, unknown or other
  misc_feature (280)..(280): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagagtcaccatcacttgccgggcagtgagagtgtggcactattggctggtatcagacaataaaccgagggaaacnccccagtaacctcctagactctatgatcgcctcgagttcgtggggacggggtcgggtaccccccatacgtaaggtcaggccganaaggtagagtcgtagggacagtaactcactctacactanacaanacgctgcagctgattgtactttgacttaacttacttactcgacctaagtagtagtaggtagttaattcggtcggtgggttcggttacgggacgtaggggaccgaaggttacgaaacgtcgaaaacgtcgtggtcgcgtcgctaac

SEQ ID NO: 313246 - DNA, 749 bp, Homo sapiens
  misc_feature: GZ8MTXP01B19SJ.2.57.F02.1.454.CMB.2.raw
  modified_base (192)..(192): a, c, t, g, unknown or other
  misc_feature (192)..(192): n is a, c, g, or t
  modified_base (205)..(205): a, c, t, g, unknown or other
  misc_feature (205)..(205): n is a, c, g, or t
  modified_base (296)..(296): a, c, t, g, unknown or other
  misc_feature (296)..(296): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctccccaccctgtcngcatcagtagganacagagtcaccatcacttcggccgggcagtgagaggttgttggtctacttagttggccgtggtactcagacaagtaaaccgaagggaaacncccccaagtacctcctagacttctaagtcgtactcgtaccctcgaggtcggtggggtacgggggtccggggtaccccccagtaacggtaacgggttcgaacggaccgggtactaagggtagtacgtacgggtaggggaaccgtaacgttaaactccctaactccacctaaccacgtaccaacgaccgtcctacgccgttacgaccgttagtacgttcggtttaacgtttacgtaaccctttaaacctttacgttaaccctacgtaacccgtaaacgtttaggtttacggttaggggtttaacggtttaaccgtttaacgggttccccggggttacggggttccggtttaccccgggggaccggtaaacgggggtaacccttaaaggggttaacgttaaaccggaaccgtaaacggtaaccgtgggtcgttaccggtaaccgttcgtaaccccg

SEQ ID NO: 313247 - DNA, 646 bp, Homo sapiens
  misc_feature: GZ8MTXP01EZ74Q.2.57.F02.1.454.CMB.2.raw
  modified_base (203)..(203): a, c, t, g, unknown or other
  misc_feature (203)..(203): n is a, c, g, or t
  modified_base (280)..(280): a, c, t, g, unknown or other
  misc_feature (280)..(280): n is a, c, g, or t
  modified_base (445)..(445): a, c, t, g, unknown or other
  misc_feature (445)..(445): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcaggtagganacagacgtcaccatcacttggccggcagtgagtgtgtgtcatagttgctggtatcagacaagtaaaccgaggaaacnccccaagacctctgatctagtgatcgaccctcgaggttcgtaggggtacggggtcgggtacccccctagtcgtaaagggttcaacgggtccggataagggtaactagtccggtaggggaactaaggtacttcctactctacaactactaccaactacgctcgacncgtcctagtaacttggttactttacgaactttaacttacttaccgacgtaacctaagtacgttaagttgggttaagttaacgtcgggtcgggttacgggggttccgttaccggggacggtaaacgggggtaaccaaaggggttacggaaaactttaaccggaaaacggtcgttgggacgggttacctcggaaccttaaccg

SEQ ID NO: 313248 - DNA, 625 bp, Homo sapiens
  misc_feature: GZ8MTXP01BB0RH.2.57.F02.1.454.CMB.2.raw
  modified_base (206)..(206): a, c, t, g, unknown or other
  misc_feature (206)..(206): n is a, c, g, or t
  modified_base (289)..(289): a, c, t, g, unknown or other
  misc_feature (289)..(289): n is a, c, g, or t
tcagacgctcgacacacgaccggtgctcgatttagctcgatatagttggggtttgggggcaggcgtcagactcagtcaggacacagcatggacatgagggtccccgctcagctcctggggctcctgctgctctggctcccaggtgccaaatgtgaccacccagatcgacccagtcctccctcccaccctgtctgcatcagtagganacagagtcacatcacttgccggcagtgagtagtgttggtctacttagttggcctaggtatcagacaagtaaaccgaggaaacnccccaagtaacctcagtactcgtatgatcgccctcgaggttcggtggggacgggggttcgggtacccccctagtacggtaacggttcgacggacgggactaaggtacgtagtacgtaggggaactagtaacttccaacgtctaccacctaataccaacgacgcctggacagtcctaggaattcgttatttacgacttaactttatacacgtacaagtagttggtacgttaggttaactcggtccgggtggggttccgtccgggacggaagggggtaaccaaaggggttcgttaaaacgtaacgaaaacggtcgttgggcgttactccgcgtaaccg

SEQ ID NO: 313249 - DNA, 305 bp, Homo sapiens
  misc_feature: GZ8MTXP01CDZU0.2.57.F02.1.454.CMB.2.raw
  modified_base (254)..(254): a, c, t, g, unknown or other
  misc_feature (254)..(254): n is a, c, g, or t
  modified_base (297)..(305): a, c, t, g, unknown or other
  misc_feature (297)..(305): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaaatgtgacacccagatgacccagtctcctcccaccctgtctgcatcagtaggagacagagtcaccatcacttgccgggccagtgagagtgtggtcactattggccnggatcagcaataaaaccagggaaaagccccagaaactcctagnnnnnnnnn

SEQ ID NO: 313250 - DNA, 729 bp, Homo sapiens
  misc_feature: GZ8MTXP01AKO47.2.57.F02.1.454.CMB.2.raw
  modified_base (205)..(205): a, c, t, g, unknown or other
  misc_feature (205)..(205): n is a, c, g, or t
  modified_base (312)..(312): a, c, t, g, unknown or other
  misc_feature (312)..(312): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctccccaccctgtctgcatcagtagganacagagtccaacctatccacgttcggccgggaccaggtgaggtagttgttggtctacgttagtttcggcctggtactcgaagacaaacgtaaaccggagggaaaccnccccgaagtacctcctagtactactagtgtactcgtaccctcggtaggttccggtagggggtacgggggttaccgggtacccccctagtacggtaacggttcgacggacggacgtaaggtagtaccgttacggtacgggtaacgtacgtacttacctactacctaaccactactaccaacgtcgctaggaccagtcctaggtattcgttaacggtttcaaccttaattacgttaacgccctaataaaccgttggttaccggttagggttaacgttaacggtttccgggtcccggggttaaggggttcccggttaaaccgggggacccgggtaaaggggaaccgttaaaggggttaacggaaaacgttaaccgaaacccgggtaattcccggggtaggaccctcgttaaccctaaccg

SEQ ID NO: 313251 - DNA, 667 bp, Homo sapiens
  misc_feature: GZ8MTXP01DI9UV.2.57.F02.1.454.CMB.2.raw
  modified_base (204)..(204): a, c, t, g, unknown or other
  misc_feature (204)..(204): n is a, c, g, or t
  modified_base (284)..(284): a, c, t, g, unknown or other
  misc_feature (284)..(284): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcagtagganacagatcacatcactgccggcagtgagagttgtggtctattagttggctggtatcagacaaagtaaaccgacgggaaacnccccgaaagtaacctctagactactatgactcgcctaccgaggtcggtagggggacggggttccggtacccccagttacggtaaagggttcgaacgggaccggacgtaaggtacgtacgtacggtagggaactagtaacttcacctctaccaccatacaaacgacgtcctgacgacgtcgtagtactttacgtttacgtttcgtaaacctttaaactttacgtacctaccggtaacctaaaggtaagtttaggtacgggtttaaacggttaaactttccgggtccggggtacgggttcccgggtaccgggaaaccgggtaacggggaacgttaaagggttacgttaaaactaacgaaaacgtgttggcgttatcgaactaacg

SEQ ID NO: 313252 - DNA, 742 bp, Homo sapiens
  misc_feature: GZ8MTXP01DT2CF.2.57.F02.1.454.CMB.2.raw
  modified_base (262)..(262): a, c, t, g, unknown or other
  misc_feature (262)..(262): n is a, c, g, or t
  modified_base (285)..(285): a, c, t, g, unknown or other
  misc_feature (285)..(285): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgaccacccagatcgacccagtcctccctccccacctgtctgcatcagtaggagacagagtccaccatccacgttcggccgggcagtgagtgtgtgtcatgttggctggtncagacaataaaccgagggaaacnccccaagaacctctagacttactatgactcgcctccgagttcggtaggggtcggggtcgggtacccccaaggttacgtaagggttccaacgggcgggactaaggtagtacgtacggtagggaactaagtaactttccgaaccttccctacctaaccaacttacccgaaacgtaccgtcccctaggccctacggtacccttaggtaagtttacggtttaactttttaacggaacttttaaacccgtttaacgttaaccctacgggtaaaccccttaaggtttaaaggtttcggttaagggggttaacgttttaaacgtttccggggttcccggggtttacgggggttacccgggtttaaccggggacccggggttaaaacgggggaacccgttaaaggggttaacggttaaaaccgtaaccgaaaacggttcggtggtacggcttaacggcttaaccg

SEQ ID NO: 313253 - DNA, 651 bp, Homo sapiens
  misc_feature: GZ8MTXP01DLMVW.2.57.F02.1.454.CMB.2.raw
  modified_base (206)..(206): a, c, t, g, unknown or other
  misc_feature (206)..(206): n is a, c, g, or t
  modified_base (238)..(238): a, c, t, g, unknown or other
  misc_feature (238)..(238): n is a, c, g, or t
  modified_base (282)..(282): a, c, t, g, unknown or other
  misc_feature (282)..(282): n is a, c, g, or t
tcagacgctcgacacacgaccggtgctcgatttagctcgatatagttggggtttgggggcaggcgtcagactcagtcaggacacagcatggacatgagggtccccgctcagctcctggggctcctgctgctctggctcccaggtgccaaatgtgaccacccagatcgacccagtcctccctcccaccctgtctgcatcagtagganacagagtcaccatcacttcgccggcagtgagngtgtgtcattagttgctggtatcagacaagtaaaccgaggaacnccccaagactctagatctatgatcgcctcgagtcgtggggacggggtcggtacccccagtacggtaacggttcaacgggacgtacgtaaggtacgtattaccgggtagggaacctaaggtacttacacttacctaccaaccaactaccgaaacgacgtccgtagacgacgtaccgtaggtaacttagggtttaacttttacggaaccttaaaactttacttacgtaccgtaaccgtaaagtaaggttaggttagggttagttaaacgttcgggtccgggttggttcccgggttacggaaccggaacggggtaacgttaaagggttagaaacgtaacgaaaacgtcgtgtacggacctaaggccctaacg

SEQ ID NO: 313254 - DNA, 650 bp, Homo sapiens
  misc_feature: GZ8MTXP01CQ3DO.2.57.F02.1.454.CMB.2.raw
  modified_base (286)..(286): a, c, t, g, unknown or other
  misc_feature (286)..(286): n is a, c, g, or t
  modified_base (377)..(377): a, c, t, g, unknown or other
  misc_feature (377)..(377): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgaccaaatgtgacacccagatcgacccagtcctccctcccaccctgtctgcatcagtaggagacagatcacatcacttgccggcaggtgagtgtgtggtcagttgttggctggtatcgagacaagtaaaccgaagggaaaccnccccaagtacctcctagacttactagtgtactccgtcctcgtagtcggtgggacggggtcggtacccccaggtacgtaggtcgaggcgganaaggtagtacgtcgtaggggaactagtaaacttccactacacaacctataaccaaacgtcgccttaggacctacggtacctaggtaacttggttacttttacgaacttaacctttacgtaactccgtaacctaaagttagtcggttacgggttaagttaaactttcggggtaaccgggttcggggacggtttaccccgggaggtaaacggggtacgttaaagggttacggttaaaactaacggaaacgtgtggtcggcttaacgccgtaaccg

SEQ ID NO: 313255 - DNA, 728 bp, Homo sapiens
  misc_feature: GZ8MTXP01BU7Y3.2.57.F02.1.454.CMB.2.raw
  modified_base (711)..(711): a, c, t, g, unknown or other
  misc_feature (711)..(711): n is a, c, g, or t
  modified_base (716)..(716): a, c, t, g, unknown or other
  misc_feature (716)..(716): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgaccacccagatgacccagtcctccctcccaccctgtctgcatcagtaggagacagacgtccaccatcacgttcggccgggactaggtgaggtagttgttggtactagttagtttcggcctggtactcgaacgacaaagtaaaacccgaacgggtaaaccgccccgtaaaggtaacctacccgtagtaactttcctaagtacgtaactttccgaccccgttaccgtacggttccgtaggggggtaccgggggttcgggggtaccccccctagttacggtaaacgggttcgacgggtcgggacgtaaggtacgacgttaccggtaggggactaaggtacttccgtaccttcctaccacctactaaccgaacgtaccggccttacggcctaacggtcctaggtaacttggtttaactttcgtaaaccttaaactttacttaacgtacgtaaacccctaaggttaaggtcgttaagggttattaacgttcggtaacgggtggttaccgggtccggacggaaggggtaaccttagggaaggaacctaacggaaacgtaaggtnacggntccgaacctaac

SEQ ID NO: 313256 - DNA, 776 bp, Homo sapiens
  misc_feature: GZ8MTXP01DLS42.2.57.F02.1.454.CMB.2.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (292)..(292): a, c, t, g, unknown or other
  misc_feature (292)..(292): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgaccagtcctccctcccacctgtctgcatcagtagganacagagtacaccatcacgttcggccggcagtgaggngttgtggtctagttagttcggctggtatcgagtacaactaaacggaaggaaacnccccaagactccagactctatgatccgtcctacgagtcggtaggggtcgggtcgggtacccctaggtacgtaagggttccacggaacggtacgtaaggtaagtacgtacggtaacgggaatacgtaactcctacttccaacctaaccagtaaccaaccgtacgtccgtacgtacgacggtacccttaggtacgttacgggttttaacgttttacgaaacccgttttaaaacctttaacgtttccggtaaaccctaaacccggttaaacggttaaacggttttagggtttaccggggtttaaaaggtttaaaccgttttaaccgggggttcccgggggtttacggggttaccccgggggttacccgggaaaccggggttaaaacggggggtaaaccgttaaaacgggggttaaacgttaaaaaccggttaacgaaaaaacggttcggttacggggtacgacggtttaaccgaaccctttaacccg

SEQ ID NO: 313257 - DNA, 661 bp, Homo sapiens
  misc_feature: GZ8MTXP01BYW80.2.57.F02.1.454.CMB.2.raw
  modified_base (289)..(289): a, c, t, g, unknown or other
  misc_feature (289)..(289): n is a, c, g, or t
  modified_base (623)..(623): a, c, t, g, unknown or other
  misc_feature (623)..(623): n is a, c, g, or t
  modified_base (645)..(645): a, c, t, g, unknown or other
  misc_feature (645)..(645): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcagtaggagacagatcacatcacttgccggcagtgagagttgtggtctacttagttcggcctggtatcaagacaacgtaaaccgagggaaaccnccccaaagaacctcctagactactagtgtactcgaccctcgtaggtcggtgggacggggttccgggtacccccctagtacggtaaagggttccgaggtaccgggtactaaggttacgtacgttcgggttacggggaactaaagttacttacctacttacctaccaacctactaaccgaaacctacggtcctagccgaacggtccttaaggtattacggtttattttacgaacctttaaactttacgtaccgtacgaacccgttaatagttaggttcggttaaggttacttcgggcgggtcggttacgttccgggacgtaacgggaacttaaggngttaaacgtaacaaagtgtcgngttctaacgctaaccg

SEQ ID NO: 313258 - DNA, 504 bp, Homo sapiens
  misc_feature: GZ8MTXP02GRNJ4.2.57.F02.1.454.CMB.2.raw
  modified_base (422)..(422): a, c, t, g, unknown or other
  misc_feature (422)..(422): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcataaaccagggaaagccccaagaaactcctgatctatgatgcctcagtctggaggtgggtcccccatcaaggttcagcggcagtagatctggggacagaaattcactctcacatcaacagcctgcagcctgatgattttgctaacttattactgaccaanagtatggtagtaattagtccgtggcgttcggcgaggggaccaaggtggaaaatcgaaaacgacgtaggtggactcgacaacc

SEQ ID NO: 313259 - DNA, 510 bp, Homo sapiens
  misc_feature: GZ8MTXP02JYOWM.2.57.F02.1.454.CMB.2.raw
  modified_base (275)..(275): a, c, t, g, unknown or other
  misc_feature (275)..(275): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccacctgtctgcatcagtaggagacagagtcaccatcacttgccgggcagtgagagtgttggtcactattggcctggtatcagcataaaccagggaaanccccagaactcctgatctatgatgcctcagtctggagggtgggtcccccatcaaggttcagcggcagtagatcgtgggacagaaattcactctcacatcaacagcctgcagcctgatgatttgctaattattactgaccaaacagtatggtgtaaattatccggtaggcggttcggccgacgggggaccaagggttacggaaatcgaaaacgtaactggtaggctcggacaaccg

SEQ ID NO: 313260 - DNA, 523 bp, Homo sapiens
  misc_feature: GZ8MTXP02HJFEY.2.57.F02.1.454.CMB.2.raw
  modified_base (278)..(278): a, c, t, g, unknown or other
  misc_feature (278)..(278): n is a, c, g, or t
  modified_base (342)..(342): a, c, t, g, unknown or other
  misc_feature (342)..(342): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcataaaccagggaaanccccagaactcctgatctatgatgcctcagtctggagggtgggccccatcaaggttcagcggcngtagatcgtgggacagaattcactctcacatcaacagcctgcagcctgatgtattttgactaactttattactgaccaaactagttaagttggtaggttaaatttagtccggtgggtccgtttacggccgtaagggggaccaaagggtcgaaaatcgaaaacgacgtgtcggctagcaacg

SEQ ID NO: 313261 - DNA, 684 bp, Homo sapiens
  misc_feature: GZ8MTXP02I68D7.2.57.F02.1.454.CMB.2.raw
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgtggtcactattggcctggtatcagcaataaaccgagggaaaccnccagactctagactntatgatcgtcctcgtaggtcgtaggggtacggggttcggtacccctagtacgtaaggttcgacggccggactaggtacgtacgtcggtagggaactaagtaacttccactcctaccaacctactaaccgaaacgacgtccctgaccctacgtccgtagtactttacgtttaacttttaccgtaacctttaaacttttacgttaaccgtaccgaacccttaaagttaggtttaaggttacgggtttaaacgtttaaacgtttacgggttaccggggtacggggttaccggttaccggggaaaccggggtaaacgggggtaaaccgtaaaaggggtaacggtaaaaactaaccggaaaacggtacggttcggacggtactacgacctaaccg

SEQ ID NO: 313262 - DNA, 553 bp, Homo sapiens
  misc_feature: GZ8MTXP02J0BPF.2.57.F02.1.454.CMB.2.raw
  modified_base (388)..(388): a, c, t, g, unknown or other
  misc_feature (388)..(388): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcataaaccgagggaaacgccccaagaactcctgatctatgatgcctcagtctgggagggtgggtcccccatcgaaggttcaggcggcagtagatcgtgggacagaattcactctacaccatcaaacngcctgcacgctgattgtatttgacttaactttattactcgacctaacgtagttagttagggttagttaaacttcgtccgggtgggtccggttcgggaccggacggggaccgtaaaggggtacgaaacgtaaccgaaaacgtaacgtcggtacggctcgaccaccg

SEQ ID NO: 313263 - DNA, 541 bp, Homo sapiens
  misc_feature: GZ8MTXP02JMZ0Y.2.57.F02.1.454.CMB.2.raw
  modified_base (278)..(278): a, c, t, g, unknown or other
  misc_feature (278)..(278): n is a, c, g, or t
  modified_base (348)..(348): a, c, t, g, unknown or other
  misc_feature (348)..(348): n is a, c, g, or t
  modified_base (378)..(378): a, c, t, g, unknown or other
  misc_feature (378)..(378): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtaggagacagagtcaccatcacttgccggcagtgagagtgtggtcactattggcctggtatcagcaataaaccgagggaaacnccccagaactcctagatctatgatgcctcagtttggagggtgggtccagtcaaggttcagcggcagtagntcgtggacagaattcactctcaccatcaanagcctgcagcctatgatttgactaactttatactacgaccaagtagtagttaggtagttaagttacgttcgggtacgggtccggttacgggaccggtaacgggggaacctaaggggtaacgaaacgtacgaaaacgtaagtcggtagcagacctacgacttcg

SEQ ID NO: 313264 - DNA, 513 bp, Homo sapiens
  misc_feature: GZ8MTXP02I02TI.2.57.F02.1.454.CMB.2.raw
  modified_base (277)..(277): a, c, t, g, unknown or other
  misc_feature (277)..(277): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (417)..(417): a, c, t, g, unknown or other
  misc_feature (417)..(417): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcataaaccagggaaanccccagaactcctgatctatgatgcctcagtctggagggtgggtccccatcaaggttcagcggcngtnatctgggacagattcactctcacatcaacagcctgcagcctgatgattttgactaacttattactgaccaanagtaatggtagtaattagtccgtgggcgttcggaccgaggggtaccaaagggttcggaaaatcgaaaacggaactaggtaggctacggactaaccg

SEQ ID NO: 313265 - DNA, 518 bp, Homo sapiens
  misc_feature: GZ8MTXP02JF2WU.2.57.F02.1.454.CMB.2.raw
  modified_base (278)..(278): a, c, t, g, unknown or other
  misc_feature (278)..(278): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactatttggcctggtatcagcataaaccagggaaanccccagaactcctgatctatgatgcctcagtctggagggtgggtcccccatcaaggttcagcggcaggtagatcgtggggacaggaattcactctcaccatcaacagcctgcagctgactgtattttgctaatttatactcgaccaaatgtatggtaggtaaattagtccggtagggtcgttcggaccgtaaggggaccaaggtacggaaataacgaaaacgaactggaggactgacacc

SEQ ID NO: 313266 - DNA, 500 bp, Homo sapiens
  misc_feature: GZ8MTXP02F98BS.2.57.F02.1.454.CMB.2.raw
  modified_base (425)..(425): a, c, t, g, unknown or other
  misc_feature (425)..(425): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcataaaccagggaaagccccagaactcctgatctatgatgcctccagtctgggagggtggggtcccccagtcgaaggttcagcggcagtagatcgtgggacagaattcatctcacatcaacagcctgcagcctgatgattttgactaacttattactgaccaanagttatggtagtaaattgtccgtggggcttcggcgaggggaccaaggtggaaatcgaaaagactggagctgacac

SEQ ID NO: 313267 - DNA, 572 bp, Homo sapiens
  misc_feature: GZ8MTXP02FRM4A.2.57.F02.1.454.CMB.2.raw
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (567)..(567): a, c, t, g, unknown or other
  misc_feature (567)..(567): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactatttggcctggtatcagcataaacccagggaaagcccccagaactcctgatctatgatgcctccagtctgggagggtggccccggtacgtcagtacgtagcgcgntagatntggtacgagaaattactactcttccacccaactacaaccaacgaccgtcgcgcgaccgttcgatgtattttagttactaaccttaaactttacttaccgtccaaaccaacgtataggttagggttaattaagttacgttcgggtcggtcggtcggacgaccgggaccgaaggtaaacggaacgaaacgaaacgtaaaacgtagtacgtcgngaccg

SEQ ID NO: 313268 - DNA, 509 bp, Homo sapiens
  misc_feature: GZ8MTXP02JUJS0.2.57.F02.1.454.CMB.2.raw
  modified_base (278)..(278): a, c, t, g, unknown or other
  misc_feature (278)..(278): n is a, c, g, or t
  modified_base (414)..(414): a, c, t, g, unknown or other
  misc_feature (414)..(414): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcataaaccagggaaanccccagaactcctgatctatgatgcctcagtctggagggtcgggtccccatcgaaggttcagcggcagtagatcgtagggacagaattcactctacacatacaacagcctgcagcctgatgtatttgctaaacttntactgaccaatgtatggtagttaatagtccggtgggcgttcggaccgaggggaccaagggtgaaaatcgaaaacgtactggtacggctcgactac

SEQ ID NO: 313269 - DNA, 581 bp, Homo sapiens
  misc_feature: GZ8MTXP02G2XPL.2.57.F02.1.454.CMB.2.raw
  modified_base (361)..(361): a, c, t, g, unknown or other
  misc_feature (361)..(361): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcacttatttggcctggtatcagacaataaaccgagggaaacgccccaagaacctcctgactctatgatcgcctcagtcgtgggaggggtcgggtccccagtcgaaggttcaggtcgganaggtagatcgtagggacagtaattcactctacacatacaacacgcctgactagcctgatgtattttgacttaactttattactgaccaactagtagttggtagttaaattcgtcggttaggggtccgtttacgggaccggtaagggggtaacccgtaaaggggttaggaaaaacgtaacgaaaaccgtaagttacggtacggccttacggacctaaaccg

SEQ ID NO: 313270 - DNA, 525 bp, Homo sapiens
  misc_feature: GZ8MTXP02I7T7M.2.57.F02.1.454.CMB.2.raw
  modified_base (280)..(280): a, c, t, g, unknown or other
  misc_feature (280)..(280): n is a, c, g, or t
  modified_base (348)..(348): a, c, t, g, unknown or other
  misc_feature (348)..(348): n is a, c, g, or t
  modified_base (430)..(430): a, c, t, g, unknown or other
  misc_feature (430)..(430): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcacttattggcctggtatcagcataaaccagggaaacnccccagaactcctgatctatgatgcctccagtctggagggtggggtcccccatcaaggttcagcggcngtagatctgggacagaattcactctcacatcaaacagccctgcagcctgattgtattttgactaacttattactgacctaanagttatggtagtaaattacgtccggtgggtcgttcggcgtaacggggaccaaagggtggaaaataacgaaaacgacgtagtggactcgacaaccg

SEQ ID NO: 313271 - DNA, 531 bp, Homo sapiens
  misc_feature: GZ8MTXP02JZ2GB.2.57.F02.1.454.CMB.2.raw
  modified_base (278)..(278): a, c, t, g, unknown or other
  misc_feature (278)..(278): n is a, c, g, or t
  modified_base (343)..(343): a, c, t, g, unknown or other
  misc_feature (343)..(343): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcataaaccagggaaanccccagaactcctgatctatgatgcctcagtctggaggtgggtcccccatcaaggttcagcggcngtagatcgtgggacagaattcactctcaccatcaacagcctgcagcctgatgtatttgactaacttattactgacctaaacagttatggttagtaaattagtaccggtgggtcggttccgggaccgtacgggggacccgtaagggtcggaaaagtcgaaaacgtaacgtggtaggctacgactaaccg

SEQ ID NO: 313272 - DNA, 504 bp, Homo sapiens
  misc_feature: GZ8MTXP02IVF6C.2.57.F02.1.454.CMB.2.raw
  modified_base (278)..(278): a, c, t, g, unknown or other
  misc_feature (278)..(278): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
  modified_base (417)..(417): a, c, t, g, unknown or other
  misc_feature (417)..(417): n is a, c, g, or t
  modified_base (492)..(492): a, c, t, g, unknown or other
  misc_feature (492)..(492): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcacttattggcctggtatcagcataaaccaggaaacnccccagaactcctgatctatgatgcctcagtctggaggtggtccccatcaagtcagcgcngtanatcgtggacagaattcactctacacatcaaacagccctgcagctgatgtatttgctaacttattactgacctaanagtatggtagtaattacgtccggtgggtacgttcggacgacggggacaaggtaggaaatcgaaaacgtctacggngctacgactacg

SEQ ID NO: 313273 - DNA, 569 bp, Homo sapiens
  misc_feature: GZ8MTXP02FU9AH.2.57.F02.1.454.CMB.2.raw
  modified_base (275)..(275): a, c, t, g, unknown or other
  misc_feature (275)..(275): n is a, c, g, or t
  modified_base (357)..(357): a, c, t, g, unknown or other
  misc_feature (357)..(357): n is a, c, g, or t
  modified_base (396)..(396): a, c, t, g, unknown or other
  misc_feature (396)..(396): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgtgtcatattggctggtatcagcaataaaccgagggaaacnccccaagaacctcctagatctatgatgcctcagtcgtgggaggggtcgggtcccccagtcgaaggttcaggcggacaggtanagtcgtaggggacaagaacttcactctacacatcaaacncgcctgcagcctgatgtatttgactaacttatactgaccaatgttagtggtagttaaattcggtaccggttggggtaccgtttacggggaccgtaaacgggggtaccgtaaaaggggtacggtaaaaacaaccgtaaaacggtacttagggtacggacgtacgacctaaaccg

SEQ ID NO: 313274 - DNA, 529 bp, Homo sapiens
  misc_feature: GZ8MTXP02J0QLF.2.57.F02.1.454.CMB.2.raw
  modified_base (279)..(279): a, c, t, g, unknown or other
  misc_feature (279)..(279): n is a, c, g, or t
  modified_base (299)..(299): a, c, t, g, unknown or other
  misc_feature (299)..(299): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
  modified_base (431)..(431): a, c, t, g, unknown or other
  misc_feature (431)..(431): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactatttggcctggtatcagcataaaccgagggaaacnccccagaactcctgatctangatgcctcagtcgtgggacgggtggggtcccccagtcaaggttcagcggcngtagatcgtgggacagaattcactctcaccatcaacngcctgcagcctgattgtatttgctaattacttactgacctaacngtatggttagtaaattcgtccggtggccgttacggaccgtacggggacctaagggtaacggaaactaacgaaaacggtactggtacggctacgaccac

SEQ ID NO: 313275 - DNA, 540 bp, Homo sapiens
  misc_feature: GZ8MTXP02H7EEH.2.57.F02.1.454.CMB.2.raw
  modified_base (343)..(343): a, c, t, g, unknown or other
  misc_feature (343)..(343): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactatttggcctggtatcagcataaaccaggaaagccccagaactcctgatctatgatgcctccagtctggaggtggggtccccatcaaggttcagcggcngtagatcgtgggacagaattcactcncacccatcaaagcgccncgcacnctgatgttatttgtactaacttacttactacgacaactagtagtaggttagttaagttacgttacggtcgggtcggttcggtaccggacgggtacgaacggtaaggtaacgtaacgtaaacgtaacgtacgtagtacgtacgtacacg

SEQ ID NO: 313276 - DNA, 503 bp, Homo sapiens
  misc_feature: GZ8MTXP02F1H17.2.57.F02.1.454.CMB.2.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
  modified_base (422)..(422): a, c, t, g, unknown or other
  misc_feature (422)..(422): n is a, c, g, or t
  modified_base (479)..(479): a, c, t, g, unknown or other
  misc_feature (479)..(479): n is a, c, g, or t
  modified_base (494)..(494): a, c, t, g, unknown or other
  misc_feature (494)..(494): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgttggtcactattggcctggtatcagcaataaaccgaggaaacgccccaagactcctgatctatgatgcctcagtcgnggaggggtgggtcccccagtcaaggttcagcggcagtagatcgtagggacagaattcaactctacacatcaacagcctgcagcctgatgtatttgactaactttatacncgtaccaatgtatggtagtaattgtccggtggcgttcgacgagggacaaggtgaaanaacgaaacgaagtgngctcgacac

SEQ ID NO: 313277 - DNA, 536 bp, Homo sapiens
  misc_feature: GZ8MTXP02HO10L.2.57.F02.1.454.CMB.2.raw
  modified_base (279)..(279): a, c, t, g, unknown or other
  misc_feature (279)..(279): n is a, c, g, or t
  modified_base (351)..(351): a, c, t, g, unknown or other
  misc_feature (351)..(351): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcataaaccagggaaacnccccagaactcctgatctatgatgcctccagtcgtgggagggtgggtccccccagtcaaggttcaggccggnaggtagatcgtaggggacagaattcactctcacatcaacagcctgcagcctgatgtattttgactaacgtttattactgacctaagagttatgggttagtaattacgtccggttgggtcgttacggaccggtacggggaaccagggtagaaactaacgaaaacgaacgtggacggctagacgtac

SEQ ID NO: 313278 - DNA, 504 bp, Homo sapiens
  misc_feature: GZ8MTXP02J1MU7.2.57.F02.1.454.CMB.2.raw
  modified_base (278)..(278): a, c, t, g, unknown or other
  misc_feature (278)..(278): n is a, c, g, or t
  modified_base (344)..(344): a, c, t, g, unknown or other
  misc_feature (344)..(344): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactatttggcctggtatcagcataaaccagggaaanccccagaactcctgatctatgatgcctcagtctggagggtgggtcccccatcaaggttcagcggcngtagatcgtgggacagaattcactctcaccatcaacagcctgcagcctgatgatttgctaacttattactgacctaaacagttatgggtagtaaattagtccggtgggcgttcgggccagggggaccaagggtgaaaatcgaaaacgactgtggctgcac

SEQ ID NO: 313279 - DNA, 525 bp, Homo sapiens
  misc_feature: GZ8MTXP02J2VBX.2.57.F02.1.454.CMB.2.raw
  modified_base (200)..(200): a, c, t, g, unknown or other
  misc_feature (200)..(200): n is a, c, g, or t
  modified_base (276)..(276): a, c, t, g, unknown or other
  misc_feature (276)..(276): n is a, c, g, or t
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
  modified_base (421)..(421): a, c, t, g, unknown or other
  misc_feature (421)..(421): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtagganacagagtcaccatcacttgccgggcagtgagagtgttggtcactatttggcctggtatcagcataaaccagggaanccccagaacctcctgatctatgatgcctcagtcgtgggagggtgggtcccccagtcgaaaggttcagcggnagtgatcgtggggacagaattcacttcnacccatcaaacncgcngcagctgattgtatttgacttaattatacngacctaagtagttagtggttagtaattcgtccggtgggtccgttcggaccgacggggacctaagggtacgaaaactcgaaaacgtcgtcggtgctacgactacg

SEQ ID NO: 313280 - DNA, 519 bp, Homo sapiens
  misc_feature: GZ8MTXP02HDNVI.2.57.F02.1.454.CMB.2.raw
  modified_base (279)..(279): a, c, t, g, unknown or other
  misc_feature (279)..(279): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcaataaaccaggaaacnccccagaactcctgatctatgatcgcctcagtcgtgggaggggtgggtcccccagtcgaaggttcaggcggcnggtantcgtggacagattcactcacacatcaacngcctgcagctgatgatttgctaattatacngaccaatgtagtggttagtaattacgtcggtgggtcttacgggacgtacgggacctaaagggtcggaaaataacgaaaacgtacgtgtcggactacgactaac

SEQ ID NO: 313281 - DNA, 534 bp, Homo sapiens
  misc_feature: GZ8MTXP02HX7XO.2.57.F02.1.454.CMB.2.raw
  modified_base (274)..(274): a, c, t, g, unknown or other
  misc_feature (274)..(274): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgttggcactattggcctggatcagcataaaccagggaaanccccagaactcctagatctatgatgcctccagtctgggagggtgggtcccccagtcgaaggttcaggcggcagtagatcgtagggacagaattcactctacaccatacaacagcctgcagctgatgtatttcgactaacttatactgacccaaatagttatgggttagtaaattacgtccgggtaggtccgttcggacccgaaggggtaccgaaagggttagaaaactcgaaaacgtacgtggtaggcctaggacaaccg

SEQ ID NO: 313282 - DNA, 583 bp, Homo sapiens
  misc_feature: GZ8MTXP02HRKTS.2.57.F02.1.454.CMB.2.raw
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcaataaaccagggaaacnccanactcngatntatgatgcctcagtcgtgggaggggtcggtaccccagtacgaaggttcaggcgganggtanatcgtagggacagtacttcactctacaactatacgaaacacgcctagacacgtcctagtatagttatttacgttacttaactttaacttaactacgtacgtaaactaagtagttaggttaggttaagttaacgttacggtcgggtacggttacggtacggtaacgggaacggtaacggtaaggtaaacgtaaacgtaaacgtaaacgtacggtaggtacgtacgtacacg

SEQ ID NO: 313283 - DNA, 572 bp, Homo sapiens
  misc_feature: GZ8MTXP02HUKSP.2.57.F02.1.454.CMB.2.raw
  modified_base (278)..(278): a, c, t, g, unknown or other
  misc_feature (278)..(278): n is a, c, g, or t
  modified_base (350)..(350): a, c, t, g, unknown or other
  misc_feature (350)..(350): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcataaaccagggaaacnccccaagaacctcctgatctatgatgcctcagtcgtgggagggtcgggtcccccatcgaaggttcagcggcngtagatcgtgggacagtaattcactctcacatacaacagccctgcagcctgattgtatttttcgacttaactttattactgaccctaagtagttagttagggttagttaaaactttcggttccgggtggggtaccgtttcgggaccggtaacgggggtaaccgaaaggggttacgaaaacgtaacgaaaacggtaacgttggacggtactcggacctaaccg

SEQ ID NO: 313284 - DNA, 557 bp, Homo sapiens
  misc_feature: GZ8MTXP02JDBFR.2.57.F02.1.454.CMB.2.raw
  modified_base (200)..(200): a, c, t, g, unknown or other
  misc_feature (200)..(200): n is a, c, g, or t
  modified_base (281)..(281): a, c, t, g, unknown or other
  misc_feature (281)..(281): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
  modified_base (544)..(544): a, c, t, g, unknown or other
  misc_feature (544)..(544): n is a, c, g, or t
tcagacgctcgacacacgaccggtgctcgatttagctcgatatagttgggtttgggggcaggcgtcagactcagtcaggacacagcatggacatgagggtcccgctcagctcctggggctcctgctgctctggctcccaggtgccaaatgtgacacccagatgacccagtctcctcccaccctgtctgcatcagtagganacagagtcaccatcacttgccgggccagtgagagtgttggtcacttattggcctggtatcagcaataaaccgagggaaacncccagaactcctgatctatgatcgcctcagtcgtgggacggggtcgggtcccccagtcgaaggttcaggtcgcagtagatccgtagggactagaacttcactctacacatacaaacngccctnaccagtcctgtaatgtaattttcgacttaaacttattactcgaacctaactagtatgggtagttatacgttcggtggtccggttacggccggtaaggggaacctaaggggttacgaaactaacgaaaccggtaatgggancgtacgactaacc

SEQ ID NO: 313285 - DNA, 500 bp, Homo sapiens
  misc_feature: GZ8MTXP02JZIBS.2.57.F02.1.454.CMB.2.raw
  modified_base (278)..(278): a, c, t, g, unknown or other
  misc_feature (278)..(278): n is a, c, g, or t
  modified_base (421)..(421): a, c, t, g, unknown or other
  misc_feature (421)..(421): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactatttggcctggtatcagcataaaccagggaaanccccagaacctcctgatctatgatgcctcagtctggaggtggggtccccatcaaggttcagcgcagtagatcgtgggacagaattcactctcaccatcaacagcctgcagcctgatgatttgctaacttattactgacccaanagtatggtagtaattactccggtggtcgttcggccaggggaccagggtagaaaactcgaaaacgactggtagctgacac

SEQ ID NO: 313286 - DNA, 605 bp, Homo sapiens
  misc_feature: GZ8MTXP02IJG44.2.57.F02.1.454.CMB.2.raw
  modified_base (201)..(201): a, c, t, g, unknown or other
  misc_feature (201)..(201): n is a, c, g, or t
  modified_base (277)..(277): a, c, t, g, unknown or other
  misc_feature (277)..(277): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcacatcacttgccggcagtgagagtgtggtcacttattggcctggtatcagcaataaaccagggaaacnccccagaacttccagatctatgatcgccttcagtcgtgggaggggtcggggtaccccccagttacgaaacgggtttcaacggtccggactagggtagtagttcgtagggggaaccaaggtaaacttcgactctaccgaaccactacaaacgacgacctacgacagcctagacttagttattttacgacttaactttattaactcgaacctaacgtagtataggtagtaaattacgttccggtagggttccggtacggtaccggaacgggtaccgtaagggtacgaaactaacgtaaaacgacgttacggtaggtacctcgactaaccg

SEQ ID NO: 313287 - DNA, 519 bp, Homo sapiens
  misc_feature: GZ8MTXP02GCYVW.2.57.F02.1.454.CMB.2.raw
  modified_base (201)..(201): a, c, t, g, unknown or other
  misc_feature (201)..(201): n is a, c, g, or t
  modified_base (390)..(390): a, c, t, g, unknown or other
  misc_feature (390)..(390): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccggccagtgagagtgtggtcactattggcctggtatcagcaataaaccgagggaaagcccccaagaactcctgatctatgatgcctccagtcgtgggaggggtcggggtcccccagtcaaggttcagcggcagtagatcgtagggacagaattcactctcacatcaacngcctgcagctgatgatttgcttaacttattactgaccaaagtagttaatgggttagtaaatttagtccggtgggcgttcggccgtagggaccaagggtagaaataacgaaaacgacgtgtgactgacac

SEQ ID NO: 313288 - DNA, 577 bp, Homo sapiens
  misc_feature: GZ8MTXP02G16IH.2.57.F02.1.454.CMB.2.raw
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgtggtcatattggctggtatcagcataaaccaggaaacnccccagaactcngatctatgatgcctcagtcgtgggagggtcgggtcccccatcgaaggttcaggcggcaggtagagtcgtagggaacaagtaattcactctacaccataccaacacgcctgacacgcctgtatgttaatttcgactaaactttatacgtcgtaacctaacgtagttagtaggttagttaaacttacggtccgggttggggtaccggtttccgggaccggtaacgggggtaccgaaacgggttaggaaaacgtaacgaaaacggtaacgtggtacgggactacggtactaaccc

SEQ ID NO: 313289 - DNA, 615 bp, Homo sapiens
  misc_feature: GZ8MTXP02HGL4K.2.57.F02.1.454.CMB.2.raw
  modified_base (286)..(286): a, c, t, g, unknown or other
  misc_feature (286)..(286): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgagacccagatgacccagtcctcctcccaccctgtctgcatcagtaggagacagacgtccaccatcacttgccggcagtgagagtgttgtcacttagttggcctggtatcgagacaagtaaaccgagggaaacnccccaagaacctcctagatctatcgatcgtcctctaggtcgtagggacggggtcggtaccccctagtacgtaaggttccaggccgagtagtagtacgtcgtagggactagacttccaactctacactanacaacncgtccngctacgctgtaagttnttacttactacttaacttataccgacgtaacgtaagttaggttagttaggttaacgttaacgttccgggtacgggtcgggttaccggttaccgggaacggtaacgggtaaacgaacggtaacggaaaacgtaaccggaaaacggttcgtacggtacgacctacgtaaccacg

SEQ ID NO: 313290 - DNA, 557 bp, Homo sapiens
  misc_feature: GZ8MTXP02FX9IF.2.57.F02.1.454.CMB.2.raw
  modified_base (201)..(201): a, c, t, g, unknown or other
  misc_feature (201)..(201): n is a, c, g, or t
  modified_base (319)..(319): a, c, t, g, unknown or other
  misc_feature (319)..(319): n is a, c, g, or t
  modified_base (538)..(538): a, c, t, g, unknown or other
  misc_feature (538)..(538): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtaganacagagtcaccatcacttgccggcagtgagagtgttggtcacttagttggcctggtatcagcaataaaccgaggggaaacccccaagaactcctagatctatgatcgcctcgagtcgnggggagggtcgggcccccagtcaaggttcaggcggacaggtagagtcgtaggggactaaggtaaacttcgaacttctaccaacaatccaaactcgccctagaccagtcctgattcgtattttcgactaaactttagtactcgacctaagtagttagtggtagtaattcgtcggtgggcgttcggacgacggggactaaggtagaaactaacgaaaacgngttggaggctacgactaac

SEQ ID NO: 313291 - DNA, 575 bp, Homo sapiens
  misc_feature: GZ8MTXP02F403Z.2.57.F02.1.454.CMB.2.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
  modified_base (396)..(396): a, c, t, g, unknown or other
  misc_feature (396)..(396): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgttggtcactatttggcctggtatcagcaataaaccgagggaaacnccccaagaacctcctgatctatgatcgcctcagtcgtgggagggtcgggtcccccagtcgaaggttcaggcggcaggtagatcgtagggacagtaattcactctacacatcaacngcctgacagcctgactgtattttcgacttaactttattactcgacctaatagtagtgggttagttaacttacgtccgggtggggtaccgttccgggaccggaacgggggtaaccgtaaaggggtacggtaaaacgtaacgaaaacggtacgttaggtacggtacgtacggacctaaccg

SEQ ID NO: 313292 - DNA, 531 bp, Homo sapiens
  misc_feature: GZ8MTXP02IMCHS.2.57.F02.1.454.CMB.2.raw
  modified_base (280)..(280): a, c, t, g, unknown or other
  misc_feature (280)..(280): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcaataaaccagggaaacnccccagaactcctgatctatgatgcctccagtctgggagggtgggtcccccatcaaggttcagcggcagtagatcgtgggacagaattcactctcaccatcaacagccctgcagcctgatgtaatttgactaactttattactgtaccaaactagtaagttgggtagtaactttagtcccggtgggtccgtttcgggccgaagggggaccgaaagggtgaaaatcgaaaacggaactggagcctagcaacc

SEQ ID NO: 313293 - DNA, 548 bp, Homo sapiens
  misc_feature: GZ8MTXP02H3ILZ.2.57.F02.1.454.CMB.2.raw
  modified_base (200)..(200): a, c, t, g, unknown or other
  misc_feature (200)..(200): n is a, c, g, or t
  modified_base (278)..(278): a, c, t, g, unknown or other
  misc_feature (278)..(278): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcacatcacttgccgggcagtgagagtgttggtcactattggcctggtatcagcaataaaccgagggaaacnccccaagaaacctcctagatctatgatgcctcagtcgtgggagggtcgggtcccccagtcgaaggttcaggcggcaggtagatcgtggggactagaattcactctacacatcaacagcctgcagcctagattgtattttgacttaaactttatactgaccaactagtatggtagttaattacggtccggtagggtccgttacggacccgaagggggtaccaagggtacgaaagttaacgaaaacgtaacgtggacggtctagacctaccg

SEQ ID NO: 313294 - DNA, 571 bp, Homo sapiens
  misc_feature: GZ8MTXP02JH28J.2.57.F02.1.454.CMB.2.raw
  modified_base (282)..(282): a, c, t, g, unknown or other
  misc_feature (282)..(282): n is a, c, g, or t
  modified_base (397)..(397): a, c, t, g, unknown or other
  misc_feature (397)..(397): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactagtttggcctggtatcagcaataaaccgagggaaacnccccaagaactcctagatctatgatcgcctcagtctgggaggggtcgggtcccccagtcgaaggttcaggcggcagtagatcgtagggacagtattcactctacaccatacaacncgcctgcacgctagatgtattttcgacttaactttattacctacgacctaaacgtagttagtagggttagttaaatacggttaccggtcgggtcggtttaccggaccggtacgggggtaccgaaaggggtaggaaactaacgaaaacgtaacgtggtacgtctacggactaccg

SEQ ID NO: 313295 - DNA, 525 bp, Homo sapiens
  misc_feature: GZ8MTXP02H4K3P.2.57.F02.1.454.CMB.2.raw
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (386)..(386): a, c, t, g, unknown or other
  misc_feature (386)..(386): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgttggtcactattggcctggtatcagcaataaaccgagggaaancctanagaactccngatctatgatgcctcagtcgnggagggtcgggtcccagtcgaaggttcaggcgnagtanagtcgtagggacagtaatcactctcaccatcaacncgctgcagctgatgtatttgactaattatactgacctaacagttagtaggtagttaaattcgtccggtagggtcgttacggaccgtaggggacctaagggtagaaacgtacgaaaacgtacgtggacggactacggacc

SEQ ID NO: 313296 - DNA, 611 bp, Homo sapiens
  misc_feature: GZ8MTXP02I13ZK.2.57.F02.1.454.CMB.2.raw
  modified_base (203)..(203): a, c, t, g, unknown or other
  misc_feature (203)..(203): n is a, c, g, or t
  modified_base (282)..(282): a, c, t, g, unknown or other
  misc_feature (282)..(282): n is a, c, g, or t
  modified_base (297)..(297): a, c, t, g, unknown or other
  misc_feature (297)..(297): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
  modified_base (453)..(453): a, c, t, g, unknown or other
  misc_feature (453)..(453): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagagtcaccatcacttggccggcagtgagagtgttggtcattattggcctggtatcagcaataaaccgagggaaacnccccaagaacctccngatctatgatcgcctcagtcgtgggagggtcggtccccagtcgaaggttcaggccggnaggtagagtcgnggganagtaacttcactctaccactataccaacncgtcctgctacgcctagtacttgttattttacgactttaactttattaaccncgaacctaaagtagttaggttagggttaagttaacgttacgtccgggtacggggtccggttaccggggaccgggtaacgggggtaacccgtaaaggggtaacggtaaaacgtaaccggtaaaacgtacggttggtacggtcctacggaaccctaaccg

SEQ ID NO: 313297 - DNA, 541 bp, Homo sapiens
  misc_feature: GZ8MTXP02F08P7.2.57.F02.1.454.CMB.2.raw
  modified_base (202)..(202): a, c, t, g, unknown or other
  misc_feature (202)..(202): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacttgccgggccagtgagagtgttggtcactatttggcctggtatcagcaataaaccgagggaaacgccccaagaactcctagatctatgatgacctcagtcgtggagggtcgggtcccccagtccgaaggttcagcggcaggtagatcgtgggacagaaattcactctacacatcaacagcctgacagcctgatgtatttgactaatttatactgaccaagtagtatggttagtaaattacgtcggtgggtcgttcgggaccgagggggacctaaagggtggaaaactaacgaaaacgtaacgtggtacgcgtacgactaaccg

SEQ ID NO: 313298 - DNA, 524 bp, Homo sapiens
  misc_feature: GZ8MTXP02F1EKH.2.57.F02.1.454.CMB.2.raw
  modified_base (278)..(278): a, c, t, g, unknown or other
  misc_feature (278)..(278): n is a, c, g, or t
  modified_base (511)..(511): a, c, t, g, unknown or other
  misc_feature (511)..(511): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggcctggtatcagcaataaaccgagggaaacnccccaagaactcctgatctatgatcgcctcagtcgtggagggtcggggtcccccagtcaaggttcaggcggcaggtagatcgtggggacagaattcactctcacatcaaacagcctgcagcctgatgattttgactaactttatactgaccaatagtatggtagttaattagtccggtgggtcgttcggacgtacggggaccaaaggtggaaaataacgaaaacgaacgtggngtactgactaacc

SEQ ID NO: 313299 - DNA, 510 bp, Homo sapiens
  misc_feature: GZ8MTXP02JT2YQ.2.57.F02.1.454.CMB.2.raw
  modified_base (425)..(425): a, c, t, g, unknown or other
  misc_feature (425)..(425): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgtggtcactattggctggtatcagcataaaccaggaaacgccccagaactcctgatctatgatgcctcagtctgggagggtgggtccccatcaaggttcaggcggcagtagatcgagggacagaattcactctacaccatacaacagcctgcagcctgatgtatttgactaactttattactgaccaanaggtatggtagtaattagtccggtgggcgttcggccgacggggaccaaggtaggaaatcgaaaacgacgtggaggctcgacaccg

SEQ ID NO: 313300 - DNA, 550 bp, Homo sapiens
  misc_feature: GZ8MTXP02FT6YW.2.57.F02.1.454.CMB.2.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
  modified_base (395)..(395): a, c, t, g, unknown or other
  misc_feature (395)..(395): n is a, c, g, or t
  modified_base (435)..(435): a, c, t, g, unknown or other
  misc_feature (435)..(435): n is a, c, g, or t
  modified_base (517)..(517): a, c, t, g, unknown or other
  misc_feature (517)..(517): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgttggtcactatttggcctggtatcagcaataaaccgagggaaacnccccaagaactcctagatctaatgatgcctccagtcgtggaggggtcgggcccccagtcgaaggttcagcggacaggtgatcgtagggacagtaatcactctacacatcaaacngcctgcagcctgaattgtattttcgactaaacttattacncgacctaagagttaagtggttagttaaaatttcgtccggtggggtcgttccggacgaacggggaccgtaaggacggtaaaanaacgaaaacgacgtaggtcggactcgactaacc

SEQ ID NO: 313301 - DNA, 549 bp, Homo sapiens
  misc_feature: GZ8MTXP02IG32M.2.57.F02.1.454.CMB.2.raw
  modified_base (280)..(280): a, c, t, g, unknown or other
  misc_feature (280)..(280): n is a, c, g, or t
  modified_base (432)..(432): a, c, t, g, unknown or other
  misc_feature (432)..(432): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctccaccctgtctccatcagtaggagacagagtcaccatcacttgccggcagtgagagtgttggtcactatttggcctggtatcagacaataaaccgagggaaacnccccaagaactcctgatctatgatcgcctccagtcgtgggagggtcggggtcccagtcgaaggttcaggcggcagtgatcgtgggacagtattcactctacaccatacaaacacgcctagcacgcctagatgtattttgacttaattatacnaccaaatagttagtggtagttaattacgtccggtgggtccgttcgggaccgtaagggggaacctaaggggtacgaaaataccgaaaacgtactaggtacgacgtacgaccaactacg

SEQ ID NO: 313302 - DNA, 527 bp, Homo sapiens
  misc_feature: GZ8MTXP02F1C44.2.57.F02.1.454.CMB.2.raw
  modified_base (282)..(282): a, c, t, g, unknown or other
  misc_feature (282)..(282): n is a, c, g, or t
  modified_base (397)..(397): a, c, t, g, unknown or other
  misc_feature (397)..(397): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
  modified_base (497)..(497): a, c, t, g, unknown or other
  misc_feature (497)..(497): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcacttattggcctggtatcagcaataaaccgagggaaacnccccaagaactcctgatctatgatcgcctccagtcgtggaggggtcgggtcccccagtcgaaggttcaggcggacagtagagtcgtagggacagtaattcaactctcacatcaancgacctgcagcctgtactgtatttgactaactttatacgngaccaangtatggtagtaattgtcgtggcgttcgacggacgggaccgaaggtagaaaacncgtaaaacgacgtacggtggctcgacaacg

SEQ ID NO: 313303 - DNA, 556 bp, Homo sapiens
  misc_feature: GZ8MTXP02HFCC2.2.57.F02.1.454.CMB.2.raw
  modified_base (201)..(201): a, c, t, g, unknown or other
  misc_feature (201)..(201): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcacatcacttgccggcagtgagagtgttggtcacttattggcctggtatcagcaataaaccgagggaaacgccccaagaactcctagatctatgatgcctcagtcgtggagggtgggtcccccagtcgaaggttcgaggcggacagtagatcgtagggacagaacttcaactctacacatacaacagccctgacagtcctagattgtatttttcgactaaatttatactgaccctaaagtagttagtgggttaagtaattacgtccggtgggtccgttacggaccgtaaggggaccgtaaaggtacgtaaaacgaacgaaaacgtaacgtgtacggctacgacaaccg

SEQ ID NO: 313304 - DNA, 620 bp, Homo sapiens
  misc_feature: GZ8MTXP02G7KJS.2.57.F02.1.454.CMB.2.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (277)..(277): a, c, t, g, unknown or other
  misc_feature (277)..(277): n is a, c, g, or t
  modified_base (400)..(400): a, c, t, g, unknown or other
  misc_feature (400)..(400): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccggcagtgagngtgtgtcactattggcctggtatcagcaataaaccgagggaaacnccccaagaacctcctgatctatgatcgcctcagtcgtgggaggggtcggtccccagtcgaaggttcaggcggacaggtagagtcgtaggggacagtaacttccactctaccaccataccaaanacgcctgcagcctagactgttatttcgacttaaactttattactacgacctaaactagttaacgttagggttaagtttaaaacttcggttacccggggttgggggtacccggtttaccggggaccggtaaacgggggtaacccgtaaaagggggttacggtaaaaacgtaaccggtaaaaacggtaacggtttaggtcggtaccgtacggacctaaaccg

SEQ ID NO: 313305 - DNA, 538 bp, Homo sapiens
  misc_feature: GZ8MTXP02GMFY4.2.57.F02.1.454.CMB.2.raw
  modified_base (281)..(281): a, c, t, g, unknown or other
  misc_feature (281)..(281): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcacttattggcctggtatcagcaataaaccgagggaaacnccccaagaacctcctgatctatgatcgcctcagtcgtgggaggggtcgggacccccagtcgaaggttcaggcggcagtagatcgtgggacagtaattcactctcacatacaacgagcctgacagcctgacttgtatttgacttaacttattactcgacctaatagttagtggtagtaaattgtccggtggtcgttcggaccgaggggacctaaggtaggaaataacgaaaacgtacgtggtacggctacgactaacg

SEQ ID NO: 313306 - DNA, 549 bp, Homo sapiens
  misc_feature: GZ8MTXP02JTHFD.2.57.F02.1.454.CMB.2.raw
  modified_base (200)..(200): a, c, t, g, unknown or other
  misc_feature (200)..(200): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (372)..(372): a, c, t, g, unknown or other
  misc_feature (372)..(372): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtagganacagagtcaccatcacttgccgggcagtgagagtgttggcactattggcctggtatcagcataaaccaggaaacnccccagaactccngatctatgatcgcctcgagtctgggagggtcggggtccccagtcaaggttcagcggcagtagatcgtaggacaggattcactcncaaccatcaacagccctagcagcctgatgtattttgacttaaactttactactcgaccaacgtagtacttgggttagttaaagttacgttccggtggggtccgttacgggaccgacggggtaaccgaaagggtacgaaaacgtaacgaaaacgtacgtagtcggactcggacaaccg

SEQ ID NO: 313307 - DNA, 562 bp, Homo sapiens
  misc_feature: GZ8MTXP02JJVIL.2.57.F02.1.454.CMB.2.raw
  modified_base (281)..(281): a, c, t, g, unknown or other
  misc_feature (281)..(281): n is a, c, g, or t
  modified_base (392)..(392): a, c, t, g, unknown or other
  misc_feature (392)..(392): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcaataaaccgaggggaaacnccccagaacctcctagatctatgatcgcctcagtcgtggagggtcgggtccccatcgaaggttcagcggcagtagatcgtagggacagtaattcactctaccacatcaacngcctgcagcctagatgtatttgactaacttattactagaccaatagtactgggttagttaaattacggtccggttagggtccggttacgggaccggtaacgggggtaacctaaagggtacggaaaactaaccgaaaacggtaacgtgggtacggtactacggacctaacg

SEQ ID NO: 313308 - DNA, 512 bp, Homo sapiens
  misc_feature: GZ8MTXP02JY5MO.2.57.F02.1.454.CMB.2.raw
  modified_base (276)..(276): a, c, t, g, unknown or other
  misc_feature (276)..(276): n is a, c, g, or t
  modified_base (342)..(342): a, c, t, g, unknown or other
  misc_feature (342)..(342): n is a, c, g, or t
  modified_base (377)..(377): a, c, t, g, unknown or other
  misc_feature (377)..(377): n is a, c, g, or t
  modified_base (409)..(409): a, c, t, g, unknown or other
  misc_feature (409)..(409): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactatttggcctggtatcagcataaaccaggaaanccccagaactcctgatctatgatgcctcagtctggaggtgggtcccccagtcaaggttcagcggcngtagatcgtgggacagaattcactctcacatcaanagcctgcagcctgatcgattttgactaacttnttactgacccaaatagtatggtagtaaattacgtccggtgggcgttcggacgtaggggaccaagggtaggaaaatcgaaaacgactaggtggactggactacc

SEQ ID NO: 313309 - DNA, 586 bp, Homo sapiens
  misc_feature: GZ8MTXP02GMQDC.2.57.F02.1.454.CMB.2.raw
  modified_base (202)..(202): a, c, t, g, unknown or other
  misc_feature (202)..(202): n is a, c, g, or t
  modified_base (280)..(280): a, c, t, g, unknown or other
  misc_feature (280)..(280): n is a, c, g, or t
  modified_base (357)..(357): a, c, t, g, unknown or other
  misc_feature (357)..(357): n is a, c, g, or t
  modified_base (393)..(393): a, c, t, g, unknown or other
  misc_feature (393)..(393): n is a, c, g, or t
  modified_base (434)..(434): a, c, t, g, unknown or other
  misc_feature (434)..(434): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacttgccgggcagtgagagtgttggtcactattggcctggtatcagcaataaaccagggaaacnccccagaacctcctgatctatgatcgcctccagtctgggagggtcgggtcccccatcgaaggttcaggcggcagtanatcgtagggacagaattcactctacacatacaaacngccctgcagcctgaactgtattttcgactaactttattacncgaccaagtagttagtggttaggttaaaattcgtaccggttggggtccgtttaccgggacccgaagggggtaaccctaaaggggtacggtaaaaacgttaaccgaaaaacgggtaaccgttagggtcgggtaccttacgggacctaaacccg

SEQ ID NO: 313310 - DNA, 692 bp, Homo sapiens
  misc_feature: GZ8MTXP02IPZ2W.2.57.F02.1.454.CMB.2.raw
  modified_base (285)..(285): a, c, t, g, unknown or other
  misc_feature (285)..(285): n is a, c, g, or t
tcagacgctcgacacacgaccggtgctcgatttagctcgatatagttgggtttgggggcaggcgtcagactcagtcaggacacagcatggaaatgagggtccccgctcagctcctggggctcctgctgctctggctcccaggtgccaaatgtgacacccagatgacccagtcctcctcccacctgtctgcatcaggtaggagacagacgtcaccatcacttcggccgggcagtgagtagtgttggtctactagttggctaggtatcagcaataaaccgaggaacnccccagtactctgactctatgatcgccctccagttcggtagggtacggggtcggggtaccctagtacgtacgggttcgaggcggtacgtagtacgtacgttacgtaggggaactaaggtaacttccgaaccttcctaccacctaataccaaaccgtcgtccctacggacctacggtacccttaggtactttagtttaacgtttttacggaaccttttaaactttaacttaccgtaaccgaaacccttaaagtaaggttaggtttaaaggggttacgtttaaacgtttacggtcccggggtttcggggtaccggtttaccggggacggtaaacgggggtaacctaaagggggtaaactaaaacgtaacggaaacgtaacgtgggttccggattaccggactaacttcg

SEQ ID NO: 313311 - DNA, 537 bp, Homo sapiens
  misc_feature: GZ8MTXP02G8F80.2.57.F02.1.454.CMB.2.raw
  modified_base (280)..(280): a, c, t, g, unknown or other
  misc_feature (280)..(280): n is a, c, g, or t
  modified_base (348)..(348): a, c, t, g, unknown or other
  misc_feature (348)..(348): n is a, c, g, or t
  modified_base (419)..(419): a, c, t, g, unknown or other
  misc_feature (419)..(419): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcaataaaccagggaaacnccccagaactcctgatctatgatcgcctcagtctggagggtgggtcccccagtcaaggttcagcggcngtagatcgtgggacagattcactctcacatcaacacgcctgcagcctgactgtatttgactaatttatacngacctaagagttatggtagtaattacgtccggtagggtcggttaccggtacggaacggggtaccgaaagggtcgaaaacgtcgaaaacggtacgttaggtcggactacggactaaccg

SEQ ID NO: 313312 - DNA, 549 bp, Homo sapiens
  misc_feature: GZ8MTXP02IATBO.2.57.F02.1.454.CMB.2.raw
  modified_base (378)..(378): a, c, t, g, unknown or other
  misc_feature (378)..(378): n is a, c, g, or t
tcagacgctcgacacacgaccggtgctcgatttagctcgatatagttgggtttggggcaggcgtcagactcagtcaggacacagcatggacatgagggtcccccgctcagctcctggggctcctgctgctctggctcccaggtgccaaatgtgacacccagatgacccagtcctcctcccaccctgtctgcatcagtaggagacagagtcacatcacttgccgggcagtgagagtgttggtcacttattggcctggtatcagcataaaccgagggaaacgccccaagaacctcctagactctatgatgcctccgagtcgtgggagggtcgggtccccagtcgaagtcagcggcagtagatcgtggacagattcactcncacatacaacacgcctgcagtcctagattgttattttcgacttaactttatacgtgaaccctaaagtagttagttggtagttaattacgttccggtgggtccgttcggaccgaagggggtaccaaggggttacgaaataaccgaaaacgtacgtggtaggacctgacctac

SEQ ID NO: 313313 - DNA, 521 bp, Homo sapiens
  misc_feature: GZ8MTXP02GG5MR.2.57.F02.1.454.CMB.2.raw
  modified_base (278)..(278): a, c, t, g, unknown or other
  misc_feature (278)..(278): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactatttggcctggtatcagcataaaccagggaaanccccagaactcctgatctatgatgcctcagtctggagggtgggtcccccatcaaaggttcagcggcagtagatcgtgggacagaattcactctcaccatacaacagcctgcagcctgatgattttgctaactttattacncgaccaaacngtataggtagtaattagtccgtgggcgtttcggccgacggggtaccaaagggtcggaaaatcgaaaacgaacgtgtacggactagtaccaacg

SEQ ID NO: 313314 - DNA, 563 bp, Homo sapiens
  misc_feature: GZ8MTXP02FT410.2.57.F02.1.454.CMB.2.raw
  modified_base (278)..(278): a, c, t, g, unknown or other
  misc_feature (278)..(278): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcaataaaccagggaaanccccaagaactcctgatctatgatgcctccagtcgtgggaggggtcggggtcccccatcgaaggttcaggcggcagtagatcgtagggacagaattcactctacacatacaacagcctagcagacctgatgtatttcgactaaactttatactagaccctaaatagttatgggtagtaaacttacgtccggtagggccgtttcgggaccgaagggggtaacccgtaaagggtaacgggaaaattaaccgaaaaacgtaacgtcggtaggtactcggactaacccg

SEQ ID NO: 313315 - DNA, 544 bp, Homo sapiens
  misc_feature: GZ8MTXP02IWG7C.2.57.F02.1.454.CMB.2.raw
  modified_base (202)..(202): a, c, t, g, unknown or other
  misc_feature (202)..(202): n is a, c, g, or t
  modified_base (283)..(283): a, c, t, g, unknown or other
  misc_feature (283)..(283): n is a, c, g, or t
  modified_base (355)..(355): a, c, t, g, unknown or other
  misc_feature (355)..(355): n is a, c, g, or t
  modified_base (397)..(397): a, c, t, g, unknown or other
  misc_feature (397)..(397): n is a, c, g, or t
  modified_base (434)..(434): a, c, t, g, unknown or other
  misc_feature (434)..(434): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacttgccgggcagtgagagtgttggtcacttatttggcctggtatcagcaataaaccgagggaaacnccccagaacctcctgatctatgatcgcctcagtcgtgggagggtcgggtccccagtcgaaggttcagcgganaggtgatcgtagggacagtaattcactctacaccatacaacngcctgcacgctgatgttatttcgactaactttatacngacctaatgtactggtagttaacttacgtccggtggtcgttcggaccgtaggggacctaaagggtagaaaactaacgaaaacggacgttggacgacgttacgacgtaacg

SEQ ID NO: 313316 - DNA, 553 bp, Homo sapiens
  misc_feature: GZ8MTXP02HOHEU.2.57.F02.1.454.CMB.2.raw
  modified_base (243)..(243): a, c, t, g, unknown or other
  misc_feature (243)..(243): n is a, c, g, or t
  modified_base (255)..(256): a, c, t, g, unknown or other
  misc_feature (255)..(256): n is a, c, g, or t
  modified_base (272)..(272): a, c, t, g, unknown or other
  misc_feature (272)..(272): n is a, c, g, or t
  modified_base (290)..(290): a, c, t, g, unknown or other
  misc_feature (290)..(290): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtcctgcatcagtaggagacagagtcacatcacttggccggcagtgagagtgttgcatnttgctgtatcannaataaacgaggaaacncccaagaacctcagactntatgatcgccttcagtcgtgggagggtcggccccatacgaaggttcaggcgacgtagtagaattcgagggaactagaaactttcaacttcaccactaanacgaaacncgcncgacacgctagtatagttatttatacttaacttacttactacgaactaactaagtagttagttaagttaagttacgttcggtcggtcggtcggacggaacggaacggaacggtaagaagtaaacgaaacgaacgtacgtacgcgtacgacac

SEQ ID NO: 313317 - DNA, 578 bp, Homo sapiens
  misc_feature: GZ8MTXP02IYZOT.2.57.F02.1.454.CMB.2.raw
  modified_base (233)..(233): a, c, t, g, unknown or other
  misc_feature (233)..(233): n is a, c, g, or t
  modified_base (277)..(277): a, c, t, g, unknown or other
  misc_feature (277)..(277): n is a, c, g, or t
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
  modified_base (391)..(391): a, c, t, g, unknown or other
  misc_feature (391)..(391): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagagtcaccatcacttgccggcagtgagngtgtgtcattattggctggtatcagcaataaaccgagggaaacnccccaagaactccagatctatgatcgcctcagtcgngggacgggtcgggacccccagtcgaaggttcagcggcaggtagntcgtagggacagacttcactcacaccatcaaacncgcctgacagactgattgtatttgacttaactttatactcgacctaaagtagttagttgggttaagttaacttacggttccgggttaggggtcccggttacgggacccggtaacgggggaaccgtaaaggggttacggaaaaacttccggaaaaacggtacgttggtacggcgtacgaccgtaaccg

SEQ ID NO: 313318 - DNA, 639 bp, Homo sapiens
  misc_feature: GZ8MTXP02J28NJ.2.57.F02.1.454.CMB.2.raw
  modified_base (201)..(201): a, c, t, g, unknown or other
  misc_feature (201)..(201): n is a, c, g, or t
  modified_base (356)..(356): a, c, t, g, unknown or other
  misc_feature (356)..(356): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccacctgtctgcatcagtagganacagagtcaccatcacttgccggcaggtgagtgtgtggtcactattggcctggtatcagcaataaaccgagggaacccccagaacctctagatctatgactgcctcagtcgtggggaggggtcgggtcccccagtcgaacgggttcaggccgganaggtagactcgtaggggacagtaaacttccaacttcaccaaccataccaaacgcgcctagcacgtcctaggtacttaggttattttacgacctttaaactttacgttaacctcgaacccttaaaagtacggtttaagttacggggttaagttaaaacgtttacggtttacccggggtgggggtacccggtttaccgggggaccgttaaacggggggaaccctaaaagggggttacggaaaacgtccgaaaaacggtcgtagggtacggctacggtcctaaccg

SEQ ID NO: 313319 - DNA, 610 bp, Homo sapiens
  misc_feature: GZ8MTXP02G5JHD.2.57.F02.1.454.CMB.2.raw
  modified_base (412)..(412): a, c, t, g, unknown or other
  misc_feature (412)..(412): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctccaccctgtctgcatcagtaggagacagagtcaccatcacttgccggccagtgagagtgttggtcactattggcctggtatcagcaataaaccagggaaacgccccagaactcctgatctatgatgcctcagtcgtggggacgggtcggtaccccagtacgtaaggttcgacggtcggactaggtacgtagtcgggtagggacaagtaacttcaacttctaccaacactacaaacncgtcctgacgacgtcctaggtatagtttatttacgaacttaactttacttactacgtaacctaaagtagttaagttaggttaagttaaacttcggtaccgggtcgggtcggttaccgggacgggtaacggggtaaccgtaacgggtaaacgtaaacgtaacgtaaaacggtacgttaggacgtacgacgtacgtaacg

SEQ ID NO: 313320 - DNA, 534 bp, Homo sapiens
  misc_feature: GZ8MTXP02I9YBJ.2.57.F02.1.454.CMB.2.raw
  modified_base (201)..(201): a, c, t, g, unknown or other
  misc_feature (201)..(201): n is a, c, g, or t
  modified_base (276)..(276): a, c, t, g, unknown or other
  misc_feature (276)..(276): n is a, c, g, or t
  modified_base (347)..(347): a, c, t, g, unknown or other
  misc_feature (347)..(347): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccggccagtgagagtgtggtcactattggctggtatcagcataaaccagggaaacnccccagaactcctgatctatgatgcctcagtcgtgggagggtcggggtccccagtcaaggttcagcggacnggtagatgtagggacagattcatctacaccatacacagccctgcagcctagattgtatttgactaactttattactgaccaagtatagtggtagttaattagtccggtgggtcgttcggacgtaagggggacctaaggggtagaaaacgtaacgaaaacggtaacgtcggtaggctacggactaacg

SEQ ID NO: 313321 - DNA, 584 bp, Homo sapiens
  misc_feature: GZ8MTXP02GZS45.2.57.F02.1.454.CMB.2.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
  modified_base (452)..(452): a, c, t, g, unknown or other
  misc_feature (452)..(452): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagagtcaccatcacttggccggcagtgagngtgtgcactnttggctgatcagcanaaacgaggaaacnccccagaactcnatctatgatgcctcagtcgngggaggggtcgggtccccagtacgaagggttcaggcggctaggtagacgtcgtaggggaacaagtaaactttccaactcctacaacccattaccgaaaactcgccctgaccacgtcctggaattgtatttcgaacttaactttatacncgtaaccaagtgttagtgggttaagttaacttcgttccgggtgggtaccgttccgggaccggtaacgggggtaacctaaaacgggttaggaaaactaacgaaaacggtcgttaggcggacttcgaactaacc

SEQ ID NO: 313322 - DNA, 535 bp, Homo sapiens
  misc_feature: GZ8MTXP02IQG29.2.57.F02.1.454.CMB.2.raw
  modified_base (282)..(282): a, c, t, g, unknown or other
  misc_feature (282)..(282): n is a, c, g, or t
  modified_base (389)..(389): a, c, t, g, unknown or other
  misc_feature (389)..(389): n is a, c, g, or t
  modified_base (432)..(432): a, c, t, g, unknown or other
  misc_feature (432)..(432): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactatttggcctggtatcagcaataaaccgagggaaacnccccaagaactcctgatctatgatgcctcagtctggagggtgggtccccatcgaaggttcaggcggcagtagatcgtagggacaggattcactctacacatcaacanccctgcagcctgatgtatttgactaacttatactcgacctaangtatggtagtaaattcgtccggtgggccgttcgggaccgtaagggggacctaaaggggtcgtaaaactcgaaaaacggtactaggtcggactcggactaaccg

SEQ ID NO: 313323 - DNA, 689 bp, Homo sapiens
  misc_feature: GZ8MTXP02IVO5J.2.57.F02.1.454.CMB.2.raw
  modified_base (204)..(204): a, c, t, g, unknown or other
  misc_feature (204)..(204): n is a, c, g, or t
  modified_base (497)..(497): a, c, t, g, unknown or other
  misc_feature (497)..(497): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgaccacccagatgacccagtcctccctcccaccctgtctgcatcagtagganacagagtcaccatcacttgccgggcagtgagtagtgttggtcacttagttggcctggtatcagacaactaaaccgagggaaaccgccccaagaacctcagatctatgatcgcctcagttcgtggggacggggtcggtccccagtacgtaaggttcgaggccggacagggtagagtccggtaggggaactaggtaaacttccaactctacaaacccataccaaacgagcccgtagacctacgccgttagtattacgtttagttttacgaactttaaaactttacgtttaaaccnccgtaaccctaaaagttaggtttaacgttaggggttaaggtttaaaactttacgggtttcccggggtagggggtttccccgggtttacccgggaacggggtaaacgggggtaaacccgtaaaagggggttacggtaaaaacttaaccggaaaacgttaacgttgggtacggtacctacggtaccctaaacgg

SEQ ID NO: 313324 - DNA, 598 bp, Homo sapiens
  misc_feature: GZ8MTXP02FW71W.2.57.F02.1.454.CMB.2.raw
  modified_base (202)..(202): a, c, t, g, unknown or other
  misc_feature (202)..(202): n is a, c, g, or t
  modified_base (280)..(280): a, c, t, g, unknown or other
  misc_feature (280)..(280): n is a, c, g, or t
  modified_base (405)..(405): a, c, t, g, unknown or other
  misc_feature (405)..(405): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacttgccgggcagtgagagtgtggtcactattggcctggtatcagcaataaaccgagggaaacncccccaagaacctcctagatctatgatcgcctcagtcgtggggacgggtcggggtcccccagtccgtaaggttcaggccggacaggtagagtcgtagggacaagtattcactctcacatcaaacncgcctgcagcctgatgtaatttgacttaacttattactcgacctaaactagttaagtggtaaggttaacttacgtacccgggttgggggtccgtttaccgggacccggtaacgggggtaaccctaaaagggggtacgaaaaacgttaaccggaaaaacgtacgttagggtccggtactacggacctaaacccg

SEQ ID NO: 313325 - DNA, 562 bp, Homo sapiens
  misc_feature: GZ8MTXP02J14UH.2.57.F02.1.454.CMB.2.raw
  modified_base (281)..(281): a, c, t, g, unknown or other
  misc_feature (281)..(281): n is a, c, g, or t
  modified_base (362)..(362): a, c, t, g, unknown or other
  misc_feature (362)..(362): n is a, c, g, or t
  modified_base (445)..(445): a, c, t, g, unknown or other
  misc_feature (445)..(445): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtcctgcatcagtaggagacagagtcaccatcacttgccgggcagtgagagtgttggtcactattggcctggtatcagcaataaaccgagggaaanccccaagaaactcctagatctatgatcgcctccagtcgtgggacgggtgggtcccccatcgaaggttcaggcggcaggtanagtcgtgggacagtaaattcacttctacaccatacaacagcctgcagcctgatgtatttgactaactttatactgacctaaanagttagtggttagtaaattcgtccgggtaggtccgttacgggaccgaagggggaaccaaaggggttacgaaaacgtcgaaaaaccggtacgtaggttacggcctacggacctaaccg

SEQ ID NO: 313326 - DNA, 517 bp, Homo sapiens
  misc_feature: GZ8MTXP02IGB02.2.57.F02.1.454.CMB.2.raw
  modified_base (200)..(200): a, c, t, g, unknown or other
  misc_feature (200)..(200): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (382)..(383): a, c, t, g, unknown or other
  misc_feature (382)..(383): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
  modified_base (415)..(415): a, c, t, g, unknown or other
  misc_feature (415)..(415): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggccagtgagagtgttggtcactattggcctggtatcagcataaaccagggaaaagccccagaaactcctgatcaatgatgcctcagtctggaggtgggtccccatcaaggttcagcggcagtagatctgggacagaaattcactncacaanacanancnncacncnatagtatttntataacttattactanacaacagtatagtagtaattaagtacgtcggtcgtcggtacgacggacggaacggtaaggtaaagtaaacgaaaacgaaacgtacgtaggtacgtacgacac

SEQ ID NO: 313327 - DNA, 521 bp, Homo sapiens
  misc_feature: GZ8MTXP02FZOSS.2.57.F02.1.454.CMB.2.raw
  modified_base (347)..(347): a, c, t, g, unknown or other
  misc_feature (347)..(347): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (495)..(495): a, c, t, g, unknown or other
  misc_feature (495)..(495): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgtggtcactatttggcctggtatcagcaataaaccagggaaacgccccagaactcctgatctatgatgcctcagtctggagggtggggtcccccatcaaggttcagcggcnggtagatcgtagggacagtaattcaactctacaccataccaaacacgcctgcagcctgattgtaattttgactaactttattacngacccaanagtatggtaggtaattcgtcgtgggtcgttcggacggagggacctaaggtgaaancgaaaacgtacgtgtagctcgacacg

SEQ ID NO: 313328 - DNA, 505 bp, Homo sapiens
  misc_feature: GZ8MTXP02JWP9M.2.57.F02.1.454.CMB.2.raw
  modified_base (278)..(278): a, c, t, g, unknown or other
  misc_feature (278)..(278): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactatttggcctggtatcagcataaaccagggaaanccccagaactcctgatctatgatgcctcagtctggaggtggggtcccccagtcgaaggttcaggcggcagtagatcgtgggacagaattcactctcacatcaacagcctgcagcctgatgtatttgactaacttatactgacccaatagtatggtagtaattagtccggtgggcgttcggacgtaggggacaaggtcgaaatcgaaacgtacgtcgtagctggcaac

SEQ ID NO: 313329 - DNA, 530 bp, Homo sapiens
  misc_feature: GZ8MTXP02ICBTP.2.57.F02.1.454.CMB.2.raw
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
tcagacgctcgacacacgaccggtgctcgatttagctcgatatagttgggtttgggggcaggcgtcagactcagtcaggacacagcatggacatgagggtcccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcaataaaccagggaaacnccccagaactccngatctatgatcgcctcagtctgggagggtcgggtccccagtcgaaggttcaggcggcagtagatcgtagggacagattcactcacacatcaaacacgcctgcagctgatgtatttgactaacttntacncgacaagtgtatggtagtaattcgtccggtggtccgttcggaccgtaagggggaccaaaggggttcgaaaactaacgaaaacggtacgtgtacggctacgacctaacg

SEQ ID NO: 313330 - DNA, 622 bp, Homo sapiens
  misc_feature: GZ8MTXP02HOF0Y.2.57.F02.1.454.CMB.2.raw
  modified_base (283)..(283): a, c, t, g, unknown or other
  misc_feature (283)..(283): n is a, c, g, or t
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
tcagacgctcgacacacgaccggtgctcgatttagctcgatatagttgggtttgggggcaggcgtcagactcagtcaggacacagcatggaaatgagggtccccgctcagctcctggggctcctgctgctctggctcccaggtgccaaatgtgacacccagatgacccagtcctcctcccaccctgtcctgcatcagtaggagacagagtcaccatcacttgccgggcagtgagagtgttggtcacttattggcctggtatcagcaataaaccgagggaaacnccccaagaacctcctgactctatgatcgcctcgagtcgtggggaggggtcgggtacccagtcgtaaggtcaggcggcagtgatcgngggacagtactcactctacaccatacaacngcctgcacgtctagtattgtattttgaactttaactttattacgtacgaaccctaaagtagtagtttacggggtaagtttaaacgtttacgtcccggggttgggtcccgggtttaccggggacccgggtaaacgggggtaaacccgtaaaacgggggttacgtaaaaacgtacccgaaaaacgggtacgttagggtccggacttacgggacccttaaccgtag

SEQ ID NO: 313331 - DNA, 514 bp, Homo sapiens
  misc_feature: GZ8MTXP02I8S37.2.57.F02.1.454.CMB.2.raw
  modified_base (201)..(201): a, c, t, g, unknown or other
  misc_feature (201)..(201): n is a, c, g, or t
  modified_base (278)..(278): a, c, t, g, unknown or other
  misc_feature (278)..(278): n is a, c, g, or t
  modified_base (349)..(349): a, c, t, g, unknown or other
  misc_feature (349)..(349): n is a, c, g, or t
  modified_base (503)..(503): a, c, t, g, unknown or other
  misc_feature (503)..(503): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggccagtgagagtgtggtcactatttggcctggtatcagcataaaccagggaaanccccagaactcctgatctatgatgcctccagtctgggagggtcggggtccccagtcaaggttcagccggcnggtagatctgggacagaattcactctcacatcaacagcctgcagcctgatgtattttgctaacttattacctgacctaacagttaatggttacgtaattacgtccggtggtcggttcggaccgaggggaccaaggtgaaatcgaaacgacgtgnggactgactac

SEQ ID NO: 313332 - DNA, 576 bp, Homo sapiens
  misc_feature: GZ8MTXP02FWN2H.2.57.F02.1.454.CMB.2.raw
  modified_base (277)..(277): a, c, t, g, unknown or other
  misc_feature (277)..(277): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcataaaccaggaaanccccagaactcctgatctatgatgcctcagtctggagggtggggtcccccagtcaaggttcagcggcagtagatcgtaggggacagaaattcaactctcaccatcaacagcctgcagcctgatgattttgactaactttattactgacctaaacagttaatggttaggtaaatttacgtcccggttggggtccgtttcgggaccggtaacgggggaacccgtaaaaggggtacgggaaaaacttaaccggaaaaaacccgtaaacgttcggtacgggtaccgttacggacgtaaacccg

SEQ ID NO: 313333 - DNA, 562 bp, Homo sapiens
  misc_feature: GZ8MTXP02JOAPF.2.57.F02.1.454.CMB.2.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (277)..(277): a, c, t, g, unknown or other
  misc_feature (277)..(277): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccggcagtgagngtgttggtcactattggctggtatcagcataaaccgagggaaacnccccaagaacctcctagatctatgatcgcctccagtcgtgggaggggtcgggtccccagtcgaaggttcaggcggcagtagatcgtagggacagattcactctacaccatacaacacgccctgacacgcctagtatgttattttcgacttaactttattacctagacctaagtagtagttagggttagttaattacgttccggtagggtccgttacggaccggtaaggggtaccgaaaggtacggaaaagtaacgaaaacgaacgtggacgacgtacgactaacg

SEQ ID NO: 313334 - DNA, 530 bp, Homo sapiens
  misc_feature: GZ8MTXP02JHGDV.2.57.F02.1.454.CMB.2.raw
  modified_base (232)..(232): a, c, t, g, unknown or other
  misc_feature (232)..(232): n is a, c, g, or t
  modified_base (384)..(384): a, c, t, g, unknown or other
  misc_feature (384)..(384): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagngtgttggtcactattggcctggtatcagcaataaaccagggaaacgccccaagaactcctgatctatgatgcctcagtcgtggagggtgggtcccccatcaaggttcaggcggcagtagatcgtgggacagaattcactctacacatcaacngcctgcagcctgatgtatttgactaatttatactgaccaaatggttatgggttagtaaattacgtccggtggggtcgttccgggaccgaagggggacctaaaggggtacgaaaatccgaaaaggtactggtacggctcgactaacc

SEQ ID NO: 313335 - DNA, 599 bp, Homo sapiens
  misc_feature: GZ8MTXP02JDMW5.2.57.F02.1.454.CMB.2.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggccagtgagagtgttggtcactatttggcctggtatcagcataaaccaggaaacnccccagactccngatctatgatgcctcagtctgggaggggtcgggtcccccatcgaaggttcaggccggcnggtagacgttcgtaggggacagtaaacttcgaacttctaccaacccatacccaaacgacgcccctagacctagccctgaattcgttatttttgacttaaaactttcttaacctcgacctaaacgtagtttaattgggttagttaaaactttcgtccggttggggtaccgtttcgggaccggtaacggggtaccgaaaggggttcgaaaagttaaccgaaaacggtactaggtcggactggacctaaacg

SEQ ID NO: 313336 - DNA, 535 bp, Homo sapiens
  misc_feature: GZ8MTXP02GAJRO.2.57.F02.1.454.CMB.2.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
  modified_base (355)..(355): a, c, t, g, unknown or other
  misc_feature (355)..(355): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggccagtgagagtgttggtcactattggcctggtatcagcaataaaccgagggaaacnccccaagaacctcctgatctatgatcgcctcagtcgtgggagggtcgggtccccatcgaaggttcaggcggacngtagatcgtagggacagtattcactctacacatcaacacgcctgcagcctagattgtatttcgactaactttatactcgacctaaactagttatggtagttaattacgttccggtgggtcgttcggaccgtaggggacctaaagggtgaaaatcgaaaacgaacgtgtggctcgactacc

SEQ ID NO: 313337 - DNA, 545 bp, Homo sapiens
  misc_feature: GZ8MTXP02G3BJO.2.57.F02.1.454.CMB.2.raw
  modified_base (199)..(199): a, c, t, g, unknown or other
  misc_feature (199)..(199): n is a, c, g, or t
  modified_base (535)..(535): a, c, t, g, unknown or other
  misc_feature (535)..(535): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacaccagatgacccagtctcctcccacctgtctgcatcagtagganacagagtcacatcacttgccggcagtgagagtgttggcacttattggcctggtatcagacaagtaaaccgagggaaacgccccaagaacctcctagatctatgatcgcctcagtcgtggagggtcgggacccccagtcgaaggttcagcggacagtagatcgtagggaacagtaacttcactcctacaaccatacaaacagccctgaccagcctagaattgttatttcgactaaactttagtacagacctaaatagttagtggtagtaaattcgtccggtgggaccgttcggacggacgggtaccgaaggtaacgaataaccgaaaagtacgtggngactcgacac

SEQ ID NO: 313338 - DNA, 613 bp, Homo sapiens
  misc_feature: GZ8MTXP02GZOV6.2.57.F02.1.454.CMB.2.raw
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggccagtgagagtgtggtcactattggctggtatcagcataaaccagggaaacnccccagactccngatctatgatcgcctcagtcgtgggagggtcgggtcccccagtcgaaggttcaggcggacaggtagatcgtaggacagacttcactctcacatcaacacgcctgacagcctagatgtaatttcgactaaactttataccgtcgacccaaagtagttagttacgggttaggttaaacttacggttaccgggttcgggggttaccggtttccgggggaacccgtaaacggggggtaacccgaaaagggggttacggtaaaaacgttaacccggaaaaacggttaaccgttcgggttaacgggcccgtttacggaaccttaaaccccg

SEQ ID NO: 313339 - DNA, 539 bp, Homo sapiens
  misc_feature: GZ8MTXP02FLZZP.2.57.F02.1.454.CMB.2.raw
  modified_base (341)..(342): a, c, t, g, unknown or other
  misc_feature (341)..(342): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgtgtcactattggctggtatcagcataaaccagggaaacgccccagaactcctgatctatgatgcctcagtcgtggagggtgggtcccccatcaaggttcaggcggnngtagatcgtgggacagaattcactctccacatacaacagcctgcagcctgatgtattttcgacttaacttattactcgacctaactagttagtggtaggttaaattacgtccggttgggtccggttcggaccggtacgggggaaccgtaaagggtggaaaactaacgaaaacgtacgtaggtcggactacgactacc

SEQ ID NO: 313340 - DNA, 567 bp, Homo sapiens
  misc_feature: GZ8MTXP02IY3WD.2.57.F02.1.454.CMB.2.raw
  modified_base (278)..(278): a, c, t, g, unknown or other
  misc_feature (278)..(278): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (374)..(374): a, c, t, g, unknown or other
  misc_feature (374)..(374): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcaataaaccaggaaacnccccagaactcagatctatgatgcctcagtctggaggtcggccccatcaaggttcagcgcngtnatcgaggacagattcatctcaccatacaaacncgcctgcagcctagagttgttatttgacttaaacttattacgtagacccaaattaggtagttagggttagttaaaacgttcgttccggggtggtaccggtttaccgggaccggtaacgggggtacctaaagggggttacggaaaacgttaaccgaaaacggtaaccgtaggtacgggactacggtacaaaccg

SEQ ID NO: 313341 - DNA, 507 bp, Homo sapiens
  misc_feature: GZ8MTXP02JGOU8.2.57.F02.1.454.CMB.2.raw
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (394)..(394): a, c, t, g, unknown or other
  misc_feature (394)..(394): n is a, c, g, or t
  modified_base (425)..(425): a, c, t, g, unknown or other
  misc_feature (425)..(425): n is a, c, g, or t
  modified_base (484)..(484): a, c, t, g, unknown or other
  misc_feature (484)..(484): n is a, c, g, or t
  modified_base (496)..(496): a, c, t, g, unknown or other
  misc_feature (496)..(496): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtaggagacagagtcaccatcacttgccgggccagtgagagtgttggtcactattggcctggtatcagcataaaccagggaaacnccccagaactcctgatctangatgcctcagtctgggagggtgggtcccccagtcaaggttcaggcggacagtagatcgtaggggacagtaacttcactctaccaccatcaaacngcctgcagcctgatgtatttgactaactttntactgacaatgtagtgtagtaattcgtacgtgggcgttcggcgacggacaaggtgaaancgaaacgactgngactcgacacg

SEQ ID NO: 313342 - DNA, 528 bp, Homo sapiens
  misc_feature: GZ8MTXP02H7ZJN.2.57.F02.1.454.CMB.2.raw
  modified_base (243)..(243): a, c, t, g, unknown or other
  misc_feature (243)..(243): n is a, c, g, or t
  modified_base (274)..(274): a, c, t, g, unknown or other
  misc_feature (274)..(274): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgccatcagtaggagacagagtcacatcacttgccggcagtgagagtgttggcactnttggcctggtatcagcataaaccaggaaacncccaagacctcagatctatgatgcctcagtcgtggggagggtcggtcccccagtcgaagtcagcgcagtagatcgtaggacagattcactcacaccatacaacagcctgcagcctgacttgtattttgactaacttagtactgacctaagtagtagttaggtagttaattacgtccgggtagggttccgttacggccggtaaacggggaccgtaagggttagaaactaacgaaacgtaagtcgagctagccaac

SEQ ID NO: 313343 - DNA, 606 bp, Homo sapiens
  misc_feature: GZ8MTXP02IJ12B.2.57.F02.1.454.CMB.2.raw
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgttggtcacttattggccttaggtatcgagacaacgtaaaccgagggaaacgccccagaactcctagatactatgatcgcctcgagtcgtggggacggggtcgggtacccccagtacgtaacggttcaggccggactagggtagacgtcgtacggggaactagtaacttccactcacacaatacaaatacgcctagaccagcctagacttgttatttcgactaactttactacgtagacctaagtgttagtggttaagtaagttacgtccggtaggggtaccgttacgggaacggtacgggggaaccgtaaaagggtacgtaaaacgtaacgaaaaacgtggtttacggacggacgttaccgacgtaaaccg

SEQ ID NO: 313344 - DNA, 522 bp, Homo sapiens
  misc_feature: GZ8MTXP02FVDIH.2.57.F02.1.454.CMB.2.raw
  modified_base (201)..(201): a, c, t, g, unknown or other
  misc_feature (201)..(201): n is a, c, g, or t
  modified_base (276)..(276): a, c, t, g, unknown or other
  misc_feature (276)..(276): n is a, c, g, or t
  modified_base (349)..(349): a, c, t, g, unknown or other
  misc_feature (349)..(349): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgtggtcactattggctggtatcagcataaaccgaggaaacnccccagaactcctgatctatgatcgcctccagtcgtgggagggtcgggtcccccatcgaaggttcaggcggcngtagatcgtaggggactagaattcactctacacatacaacagcctgcagcctgattgtattttgacttaacttatactgaccaatgtatggtagtaattcgtcggtgggtcgttcggacgaggggacctaaggtagaaacgtaacgaaaacgacgtggtcgactagactaacg

SEQ ID NO: 313345 - DNA, 492 bp, Homo sapiens
  misc_feature: GZ8MTXP02GBDPQ.2.57.F02.1.454.CMB.2.raw
  modified_base (276)..(276): a, c, t, g, unknown or other
  misc_feature (276)..(276): n is a, c, g, or t
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
  modified_base (481)..(481): a, c, t, g, unknown or other
  misc_feature (481)..(481): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgtggtcactattggcctggtatcagcataaaccagggaaanccccagaactcctgatctatgatgcctcagtctggagggtcggggtccccatccaaggttcagcggcagtagatctgggacagaattcactctcacatcaaacngcctgcagcctgatgatttgctaattntactgaccaangtatggtagtattanccggtggcttcggcgacggggacaaggtgaaaatcgaaaacgactagngtactgactac

SEQ ID NO: 313346 - DNA, 574 bp, Homo sapiens
  misc_feature: GZ8MTXP02I9D9E.2.57.F02.1.454.CMB.2.raw
  modified_base (201)..(201): a, c, t, g, unknown or other
  misc_feature (201)..(201): n is a, c, g, or t
  modified_base (280)..(280): a, c, t, g, unknown or other
  misc_feature (280)..(280): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggccagtgagagtgtggtcactattggcctggtatcagcaataaaccgagggaaacnccccagaacctcctgatctatgatgcctccagtctgggacgggtcggggtcccccagtacgaaggttcaggccggcaggttagagttcgtaggggaactaaggaactttcgaaccttctaccaaccataccaacagccctgcagcctagatcgtatttgactaactttatactgaccctaataggtattgggtagttaaattcgtccggttgggccgttcgggaccgaagggggacctaaaggggttacggaaaattccgaaaacggacgttggacggtactacggacaaaccg

SEQ ID NO: 313347 - DNA, 508 bp, Homo sapiens
  misc_feature: GZ8MTXP02HAOEG.2.57.F02.1.454.CMB.2.raw
  modified_base (232)..(232): a, c, t, g, unknown or other
  misc_feature (232)..(232): n is a, c, g, or t
  modified_base (270)..(270): a, c, t, g, unknown or other
  misc_feature (270)..(270): n is a, c, g, or t
  modified_base (281)..(281): a, c, t, g, unknown or other
  misc_feature (281)..(281): n is a, c, g, or t
  modified_base (380)..(380): a, c, t, g, unknown or other
  misc_feature (380)..(380): n is a, c, g, or t
  modified_base (413)..(413): a, c, t, g, unknown or other
  misc_feature (413)..(413): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagngtgtgtcactattgctgtatcagcataaaccaggaacnccccagactcngatcatgatcgcctcagtcgtggacggggtgggcccccagtcaaggttcaggcggcagtagatcgtagggacagtaattcaactctacacatacaaacngcctgcagctgactgtatttgactaattatacngaccaagtagtagtggtagtaatcgtccggtgggtctacggacgacggggacaagggtgaaaacaacgaaaacgtacgtggtacgctacgactac

SEQ ID NO: 313348 - DNA, 541 bp, Homo sapiens
  misc_feature: GZ8MTXP02H83FF.2.57.F02.1.454.CMB.2.raw
  modified_base (281)..(281): a, c, t, g, unknown or other
  misc_feature (281)..(281): n is a, c, g, or t
  modified_base (433)..(433): a, c, t, g, unknown or other
  misc_feature (433)..(433): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcacttattggcctggtatcagcaataaaccagggaaacnccccagaactcctgatctatgatgcctccagtctgggaggggtggggtcccccagtcgaaggttcagcggcagtagatcgtgggacagaattcactctcaccatacaaacacgcctgacagcctgattgtattttgactaaactttattacngacccaaatagtagtggttaggtaaattagtccggttgggcggtttcggaccgtacggggaccgtaaaggtaggaaaataacgaaaacgaactggtaggctaggacac

SEQ ID NO: 313349 - DNA, 589 bp, Homo sapiens
  misc_feature: GZ8MTXP02GT9WW.2.57.F02.1.454.CMB.2.raw
  modified_base (275)..(275): a, c, t, g, unknown or other
  misc_feature (275)..(275): n is a, c, g, or t
  modified_base (445)..(445): a, c, t, g, unknown or other
  misc_feature (445)..(445): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctccaccctgtctgcatcagtaggagacagagtcaccatcacttgccgggcagtgagagtgtggtcactattggctgtatcagcaataaaccgaggaaacnccccagaactcctgatctatgatgcctcagtcgtgggaggggtcggggtcccccagtcgaaggttcaaggcggactaggtagagtccgtaggggacaagtaattcactcctacaccatcaaacagccctgccagcctgaattgtaattttcgacttaaactttacttacncgaccaaacgtagttatgggttaagttaatacgttccggtacgggtcgttaccgggaccggtaacgggggtacctaaaacggggtacggtaaaaacaaccgtaaaaacggtaacgttgggtacggtaccgtacggacctaaccg

SEQ ID NO: 313350 - DNA, 542 bp, Homo sapiens
  misc_feature: GZ8MTXP02I998Q.2.57.F02.1.454.CMB.2.raw
  modified_base (276)..(276): a, c, t, g, unknown or other
  misc_feature (276)..(276): n is a, c, g, or t
  modified_base (349)..(349): a, c, t, g, unknown or other
  misc_feature (349)..(349): n is a, c, g, or t
  modified_base (429)..(429): a, c, t, g, unknown or other
  misc_feature (429)..(429): n is a, c, g, or t
tcagacgctcgacacacgaccggtgctcgatttagctcgatatagttgggtttggggcaggcgtcagactcagtcaggacacagcatggacatgagggtcccgctcagctcctggggctcctgctgctctggctcccaggtgccaaatgtgacacccagatgacccagtctcctcccaccctgtctgcatcagtaggagacagagtcaccatcacttgccggcagtgagagtgttggtcactatttggcctggtatcagcataaaccagggaaacnccccagaactcctgatctatgatcgcctcagtctggagggtgggtcccccatccaaggttcagcggcaggtanagtcgtggggacagaattcaactctacaccatccaacagccctgccagcctgaattgtattttgactaaactttattacncgtaccaaacgtgttaagttggtagttaaattgtcccggtggggtcgttacgggccaagggggaccaaagggtggaaaactcgaaaacgtacgtggtacggctacgactaacc

SEQ ID NO: 313351 - DNA, 617 bp, Homo sapiens
  misc_feature: GZ8MTXP02JMJWO.2.57.F02.1.454.CMB.2.raw
  modified_base (281)..(281): a, c, t, g, unknown or other
  misc_feature (281)..(281): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagagtcaccatcacttgccggcagtgagagtgttggtcacttatttggcctggtatcagcaataaaccgaggaaacnccccagactctgatctatgatcgcctcagtcgtgggaggggtcgggtccccagtcgaaggttcaggcggacaggtagattcgagggacaagtaacttcgacttctaccaccctatccaaacagtccctagcaagtcctaggacttggtattttcgaacttaacctttagttactacgaccctaaatagttagttcgggttagttaaacgttcggttccgggttaggggtacccggttccgggaccggtaacgggggtaacccggtaaggggttaaccggaaaacgtaaccggtaaaacggtacgttacgggtacgggtactacggaccctaaccgg

SEQ ID NO: 313352 - DNA, 575 bp, Homo sapiens
  misc_feature: GZ8MTXP02G961R.2.57.F02.1.454.CMB.2.raw
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgttggtcacttattggcctggtatcagcaataaaccgaggaaacnccccagaactccngatcatgatcgcctcagtcgtgggaggggtcgggtcccccagtcgaaggttcaggcggacagttagatcgtaggggacagaactttcaactcctacaaccataccaagtacgccctgacaaggcctagattacgttatttcgactaaactttacgtactacgacctaaagtagttaggttagggttagttaaaacttcggttccgggtagggtccgttacggacggtacgggggaaccaagggtaggaaaactcgaaaacgtacgtggtcgacgtcgactacg

SEQ ID NO: 313353 - DNA, 521 bp, Homo sapiens
  misc_feature: GZ8MTXP02IAXUX.2.57.F02.1.454.CMB.2.raw
  modified_base (279)..(279): a, c, t, g, unknown or other
  misc_feature (279)..(279): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggccagtgagagtgttggtcactattggcctggtatcagcaataaaccagggaaacnccccagaactcctgatctatgatcgcctccagtcgtgggaggtcggggtccccagtcgaaggttcacggcggcagtagatcgtgggacaaggattcaactctacacatcaaacagcctgcagcctagatgtatttgacctaatttagtactgaccaactgtactggtagtattagtcggtggcgttcggacgaggggtacaaggtagaaactcgaaaacgtacgtagtaggtctacgctaac

SEQ ID NO: 313354 - DNA, 640 bp, Homo sapiens
  misc_feature: GZ8MTXP02HJZL2.2.57.F02.1.454.CMB.2.raw
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (432)..(432): a, c, t, g, unknown or other
  misc_feature (432)..(432): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtaggagacagagtcaccatcacttgccggcagtgagngtgttgtcatattggctggtatcagcaataaaccgaggaaacnccccaagaactcctagatactaatgatcgccctacgagttcgtggggacggggtcggggtcccccccagtaccgaaaggttcgaaggccgggacaggttacgataccgtaggggaactagtaaacttcaaccttcaccgaaccagtaaccaaacgngccctgaccgaagtccctagattgtatttcgaacttaactttatactacgaccctaaagtagttaagttggttaaggtttaaacttacggttccgggtagggggtccgtttaccgggaccggtaaacgggggtaaccctaaaaggggtaccggtaaaaagtccgaaaaaccggtaacgttcgggtacggaccttacggaacctaaccg

SEQ ID NO: 313355 - DNA, 532 bp, Homo sapiens
  misc_feature: GZ8MTXP02G5HGN.2.57.F02.1.454.CMB.2.raw
  modified_base (348)..(348): a, c, t, g, unknown or other
  misc_feature (348)..(348): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactatttggcctggtatcagcataaaccagggaaacgccccaagaactcctgatctatgatgcctcagtctgggaggtggggcccccagtcaaggttcagcggcngtagatcgtgggacagaattcaacttctcaaccatacaacagccctgcacgcctgatgtatttgactaactttatactgaccaaatagtagtggtaggttaattagtccggtggggtccttcgggaccgaagggggacctaaagggtagaaaatcgtaaaaccgacgttaggcgactcgactac

SEQ ID NO: 313356 - DNA, 579 bp, Homo sapiens
  misc_feature: GZ8MTXP02H4T95.2.57.F02.1.454.CMB.2.raw
  modified_base (202)..(202): a, c, t, g, unknown or other
  misc_feature (202)..(202): n is a, c, g, or t
  modified_base (459)..(459): a, c, t, g, unknown or other
  misc_feature (459)..(459): n is a, c, g, or t
tcagacgctcgacacacgaccggtgctcgatttagctcgatatagttgggtttgggggcaggcgtcagactcagtcaggacacagcatggacatgagggtcccccgctcagctcctggggctcctgctgctctggctcccaggtgccaaatgtgacacccagatgacccagtctcctcccaccctgtctgcatcagtagganacagagtcaccatcacttgccgggcagtgagagtgttggtcacttattggcctggtatcgagcaagtaaaccgagggaaacgccccaagaacctcctagatctatgatcgcctcagtcgtgggagggtcggtccccagtcgaaggttcagcggacaggtagagtcgtaggggaacagtaaattccaaccttcaccaaccataccaaacacgccctagcaacgcctagacttagtattttacgactttaacttatacngtaccaagtagtagttggtagttaacttcgttcggtgggtccgtttacgggccggaacggggtaccgaaagggttacgaaaacttaacgaaacggtaacgtcggtagaccgtcgaccacg

SEQ ID NO: 313357 - DNA, 511 bp, Homo sapiens
  misc_feature: GZ8MTXP02IXNFQ.2.57.F02.1.454.CMB.2.raw
  modified_base (283)..(283): a, c, t, g, unknown or other
  misc_feature (283)..(283): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtaggagacagagtcaccatcacttgccgggccagtgagagtgttggcacttattggcctggtatcagcaataaaccgagggaaacnccccaagaacctcctgactctatgatcgcctcagtcgtggggagggtcggggtccccagtcgtaaggttcaggcggcaggtagatcgtagggacagtaacttcactctacaccatcaaacncgcctncagctgatgtatttnactaacttntacngaccaatgtatggtagtattgtcggtggtcgtcggcgagggacaaggtagaatcgaaacgatcgagctgctac

SEQ ID NO: 313358 - DNA, 556 bp, Homo sapiens
  misc_feature: GZ8MTXP02HTA8P.2.57.F02.1.454.CMB.2.raw
  modified_base (344)..(344): a, c, t, g, unknown or other
  misc_feature (344)..(344): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtaggagacagagtcaccatcacttgccggcagtgagagtgttgcactattggcctggtatcagcaataaacgaggaaacgccccagaacctcctagactctatgatgcctcagtcgtggagggtcggtccccagtcgaggttcaggcgangtagatcgtggaacagaaactcgaacttcgtacaacctataccaactacgtcctaggacacgtctagattcgttatttacgattaacgttatatcgactaacgtagtcgtaggtagtaattcgtccggtagggccgttacggacggaacgggtaacctaaggggttaagaaaacgttaacgaaaacgtacgtaggtcgtacctacgactacg

SEQ ID NO: 313359 - DNA, 551 bp, Homo sapiens
  misc_feature: GZ8MTXP02G2S5U.2.57.F02.1.454.CMB.2.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
  modified_base (410)..(410): a, c, t, g, unknown or other
  misc_feature (410)..(410): n is a, c, g, or t
  modified_base (452)..(452): a, c, t, g, unknown or other
  misc_feature (452)..(452): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgttggtcactattggcctggtatcagcaataaaccgaggaaacnccccaagaacctcctgactctatgatcgcctcagtcgtgggacgggtcggggtccccagtacgaaggttcaggtccggacaggtacgagtccgtagggacaagtaacttcaacttctaccacatacaaacncgccctagccagcctagacttgtatttgactaacttagtacngaccaagtagtatggtagtaaagttctacgggtggtccttacgggcgaacggggactaaggtcgaaaatcgaaaacgtacgtcgcgactacgacctacg

SEQ ID NO: 313360 - DNA, 535 bp, Homo sapiens
  misc_feature: GZ8MTXP02GXONY.2.57.F02.1.454.CMB.2.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgttggtcactattggcctggtatcagcataaaccgagggaaacnccccagaactcctgatctatgatgcctccagtcgtgggaggggtcggggtaccccccagtcgaaaggttcaggtccggcaggtagatcgtaggggacagaattcactctcaccatcaacagcctgcagcctgatgtattttgactaactttatactgaccaatagtatgggttagtaaattacgtccggtgggaccgttcggaccgaggggaccaaagggtcgaaaatcgaaaacgaactggtaggctgactaccg

SEQ ID NO: 313361 - DNA, 731 bp, Homo sapiens
  misc_feature: GZ8MTXP02IGM74.2.57.F02.1.454.CMB.2.raw
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
  modified_base (286)..(286): a, c, t, g, unknown or other
  misc_feature (286)..(286): n is a, c, g, or t
tcagacgctcgacacacgaccggtgctcgatttagctcgatatagttgggtttgggggcaggcgtcagactcagtcaggacacagcatggacatgagggtccccgctcagctcctggggcctcctgctgctctggctcccaggtgccaaatgtgaccacccagatgacccagtcctccctcccaccctgtctgcatcagtagganacagagtcaccatcacttggccggcagtgagngtgtgtcacttagttgctggtatcagacaacgtaaaccgagggaaaccnccccaagaacctcctagactctatgactcgtccctccgagtccgtggggacggggttcggggtccccctagtcgtaaaggttcgaggtccggctaggtagtacgtcggtagggaactaaggtaaacttccgaaccttctaccctaaccataccaaacgcgccctgaccacgtcctagtaacttggttaacttttacgaaccttaacttttaacgttaccgtaccgtaaccctaaagttaggtttaaacgttggggttaaacggttttaaacgttacccgggtttaccggggttcgggggttcccgggtttaccgggggaaaccccggggtaaacggggggtaaacccgtaaaagggggtttaacggtaaaaaccgtaaccggggtaaaaaaccggttaaccggttcggggtaccgggtaccgttaccggacccgtttaaaccccg

SEQ ID NO: 313362 - DNA, 528 bp, Homo sapiens
  misc_feature: GZ8MTXP02GEYFK.2.57.F02.1.454.CMB.2.raw
  modified_base (201)..(201): a, c, t, g, unknown or other
  misc_feature (201)..(201): n is a, c, g, or t
  modified_base (358)..(358): a, c, t, g, unknown or other
  misc_feature (358)..(358): n is a, c, g, or t
  modified_base (404)..(404): a, c, t, g, unknown or other
  misc_feature (404)..(404): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgttggtcactattggctggtatcagcaataaaccagggaaacgccccagaactcctagatctatgatcgcctccagtcgtggggaggggtcggggtacccccagtacgaaggttcaggccggnaggtagatcgtaggggacaagtattcaactctaccacatacaaacngcctgcagcctgatgtatttgactaactttatactcgactaactgtaagtggtagtaattacgtcggtgggtcgtcggacgacgggaccgaaggngtaaacncgaaacgagtggtgctcgcaac

SEQ ID NO: 313363 - DNA, 569 bp, Homo sapiens
  misc_feature: GZ8MTXP02IY3WH.2.57.F02.1.454.CMB.2.raw
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (353)..(353): a, c, t, g, unknown or other
  misc_feature (353)..(353): n is a, c, g, or t
  modified_base (426)..(426): a, c, t, g, unknown or other
  misc_feature (426)..(426): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcacatcacttgccggcagtgagagtgtggtcactattggcctggtatcagcataaaccgaggaaacnccccagactcngatctatgatcgcctcagtcgtgggagggtcgggtcccccagtcgtaaggttcaggcggacaggtanagtcgtaggacagaattcactcacacatacaacagcctgcacgctgactgtatttcgactaactttgttaacncgaacctaagtagttaagtggtttaggtaaaattcggtttccggggttagggaccggtttccgggaaccggaacgggggtaaccaaaggggtagtaaaaacgtaaccgaaaacggtacttagggtcgacgttcgactaacccg

SEQ ID NO: 313364 - DNA, 521 bp, Homo sapiens
  misc_feature: GZ8MTXP02G24FQ.2.57.F02.1.454.CMB.2.raw
  modified_base (276)..(276): a, c, t, g, unknown or other
  misc_feature (276)..(276): n is a, c, g, or t
  modified_base (348)..(348): a, c, t, g, unknown or other
  misc_feature (348)..(348): n is a, c, g, or t
  modified_base (386)..(386): a, c, t, g, unknown or other
  misc_feature (386)..(386): n is a, c, g, or t
  modified_base (418)..(418): a, c, t, g, unknown or other
  misc_feature (418)..(418): n is a, c, g, or t
tcagacgctcgacacacgaccggtgctcgatttagctcgatatagttgggtttggggtcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggcactattggcctggtatcagcataaaccaggaaanccccagaactctgatctatgatgcctcagtcgtgggaggggtgggtcccccagtcgaaaggttcaggcggcngtagatcgtgggacagattcactctacaccatcaaacngcctgacagcctgatgtatttgactaactttntacgaccaatgtatgggtagtaattgtccggtgggtccgttcgggacctagggggaccaaaggtggaaaactcgaaaacggtactggtacgctacggctaacc

SEQ ID NO: 313365 - DNA, 663 bp, Homo sapiens
  misc_feature: GZ8MTXP02IKMMR.2.57.F02.1.454.CMB.2.raw
  modified_base (201)..(201): a, c, t, g, unknown or other
  misc_feature (201)..(201): n is a, c, g, or t
  modified_base (274)..(274): a, c, t, g, unknown or other
  misc_feature (274)..(274): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccacctgtctgcatcagtagganacagagtcacatcacttgccggcagtgagagtgtgtcatattggcctggtatcagacataaaccgaggaaacnccccagaactccagatactatgatcgcctaccgagtcgtgggacgggtcggtcccccagtacgtaaggttcaggcggacagtagatcgagggactagaattcacttcaccacataccaaacgacgtcctagaccgacgtacctagtaaacgtttgttaacgtttttacgaaccttaaaacgttttacttaaacccgtgaaacccctaaaaggtaggtttaacgttaggggtttacgtttaaaacgtttacggttccggggtacgggggtttaccggttaccgggaacccggggtaaacgggggtaaccccgtaaaaggggtttaacggaaaaccttaaaaccggaaaacggtaacgttacgggtacgtaccgttacgacccgtaaaccg

SEQ ID NO: 313366 - DNA, 614 bp, Homo sapiens
  misc_feature: GZ8MTXP02G1YQ9.2.57.F02.1.454.CMB.2.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (281)..(281): a, c, t, g, unknown or other
  misc_feature (281)..(281): n is a, c, g, or t
  modified_base (413)..(413): a, c, t, g, unknown or other
  misc_feature (413)..(413): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcacatcacttgccggcagtgagngtgttggtcacttatttggcctggtatcagacaataaaccgagggaaacnccccaagaacctcctagatctatgatcgcctcgagtcgtgggacgggtcgggcccccagtcgtaaggttcaggccggacaggtagacgttcgtaggggactaagtaacttcaactctaccactataccaacngccctgccacgcttgaacttgttatttcgacttaaactttcgtaacctgaaccctaagtacgttagtagggttacgttaaacttcggttccgggtaggggtcccgtttacggggacccggtaaagggggtacccgtaaaggggtaggtaaaaccgtaacgtaaaaaccggtagtacgggttcggacttacggaacctaccg

SEQ ID NO: 313367 - DNA, 659 bp, Homo sapiens
  misc_feature: GZ8MTXP02F6NTY.2.57.F02.1.454.CMB.2.raw
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagngtgtggtcactattgctggtatcagcaataaaccgaggaaacnccccaagacctctagatctatgatcgcctcgagtcgtagggacggggtcggggtacccccagtacgaaaggtttcaaggccggactaggtagacgttcggtaggggaacaaggtaaactttacaaccttctaaccaaccaactaccaaacacgccctagaccacgcctagtaattgttaagtttttcgaacttaaactttaatttaccgacgaccctaaagtaaggtttacgttagggttaaggttaaaactttcggttcccgggttagggggttaccggtttaccgggtaaccgggaaaccgggggtaaccgtaaaaggggttaacggaaaacgttaaccgaaaaacggtaacgttgggttacggactacggactaaacccg

SEQ ID NO: 313368 - DNA, 571 bp, Homo sapiens
  misc_feature: GZ8MTXP02IEH1L.2.57.F02.1.454.CMB.2.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
  modified_base (354)..(354): a, c, t, g, unknown or other
  misc_feature (354)..(354): n is a, c, g, or t
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
  modified_base (432)..(432): a, c, t, g, unknown or other
  misc_feature (432)..(432): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcacatcacgttgccggcagtgagtagtgttggctattgttggcctggtatcagcaataaaccgaggaaacnccccagaactcagatctatgatcgcctcgagtcgtggggtagggtcggaccccagtcgaagtcaggcgcagtagntcgtaggatagaattcacttcacaacntacaaacngcctgacacgctagattgttatttcgaacttaactttattacncgaaacctaagtaggttaagttggttaacgttaacgttacggtcccggggttaggggtccgttacggaccggggaaaggggtaaccgaaaggggtagaaaactaaccgtaaaacggtatcggtaacgccgtagacctac

SEQ ID NO: 313369 - DNA, 582 bp, Homo sapiens
  misc_feature: GZ8MTXP02H1LS4.2.57.F02.1.454.CMB.2.raw
  modified_base (200)..(200): a, c, t, g, unknown or other
  misc_feature (200)..(200): n is a, c, g, or t
  modified_base (278)..(278): a, c, t, g, unknown or other
  misc_feature (278)..(278): n is a, c, g, or t
  modified_base (357)..(357): a, c, t, g, unknown or other
  misc_feature (357)..(357): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacaccagatgacccagtctcctcccaccctgtctgcatcagtagganacagagtcaccatcacttgccgggccagtgagagtgttggcattattggcctggtatcagcaataaaccagggaaacnccccaagaactccagatctatgatgcctcagtctggggacgggtcgggtccccagtcgaaggttcaggcggacaggtanatcgtagggaacagtaaattcactctacaccataccaaacacgccctgacaacgcctagaattgtatttttcgacttaactttattacctacgacctaaacgtagtagttacggttagttaattacgttccggtggggttaccggttacggaccggtaacggggaccgtaaagggtacggaaactaacggtaaaacgtacgtacggtacggactacgacgtaccg

SEQ ID NO: 313370 - DNA, 578 bp, Homo sapiens
  misc_feature: GZ8MTXP02IP3B0.2.57.F02.1.454.CMB.2.raw
  modified_base (422)..(422): a, c, t, g, unknown or other
  misc_feature (422)..(422): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtaggagacagagtcaccatcacttgccggccagtgagagtgttggtcactattggcctggtatcagcaataaaccgagggaaacgccccagaacctcctgatctatgatcgccctcaggtccgtggggacggggtcggggtcccccagtcgaaggttcacggccggcaggtagatcggtaggggaacctaaggtaaactttccacttcaccaccctaatcaaaacngccctgaccacgtcctaggattgttattttgaccttaactttagtacctcgacctaaagtgttacgtggttaagtattacggtcgggtggcggttcgacggaaggggtaccaagggttacgaaagttaacgaaacgtagtggacgctacgactacg

SEQ ID NO: 313371 - DNA, 534 bp, Homo sapiens
  misc_feature: GZ8MTXP02GYO8A.2.57.F02.1.454.CMB.2.raw
  modified_base (281)..(281): a, c, t, g, unknown or other
  misc_feature (281)..(281): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactatttggcctggtatcagcaataaaccagggaaacnccccagaaacctcctagatctatgatcgcctcagtcgtgggaggggtcggggtcccccagtacgaaggttcaggcggcaggtagatcgtaggggactaggaaacttcgaactctacaccatcaaacagccctgcagcctgatgtatttgactaactttatactgaccaatagtagtggtagtaattagtccggtggtcgtcggcgaggggtaccaggtacgaaagtaacgaaacgacgtgtgactagctaccg

SEQ ID NO: 313372 - DNA, 595 bp, Homo sapiens
  misc_feature: GZ8MTXP02F60W3.2.57.F02.1.454.CMB.2.raw
  modified_base (423)..(423): a, c, t, g, unknown or other
  misc_feature (423)..(423): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcaataaaccagggaaacgccccaagacctcctgatctatgatgcctccagtctggagggtcggggtcccccagtcaaggttcagcggcagtagatcgtagggacagaattcactctacacatcaacagcctgcagcctgatgtatttgactaatttatacncgacctaacgtagtagttgggttaagttaaaatttcgttcccggggttaggggtcccggtttaccggggaccggaaacgggggtacccgtaaagggggttaacggtaaaaactaaccggtaaaaacccggtaacgtttaacggggtcggtaccgtacggacccgtaaacccg

SEQ ID NO: 313373 - DNA, 597 bp, Homo sapiens
  misc_feature: GZ8MTXP02F7359.2.57.F02.1.454.CMB.2.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcaccatcacttgccgggcagtgagagtgtggtcacttattggcctggtatcagcaataaaccgaggaaacnccccagactctgatctatgatcgcctcgagtcgtgggaggggtcggtcccccagtccgaaggttcacgtcggcgtagtagactcggtggggaactaagtacttccacgtctaccactatacaaacgcgccctagccagtcctgtaagtgttatttaggaccttaatttacgttactcgaacctaacgtagttaacgtggttaagtaacgtttacgtccgggttacgggtccggttaccggacggacggggtaaccgtaaggggtaacgtaaaacgttaacgaaaccggagttacggtacggccgtaacgacctaaccg

SEQ ID NO: 313374 - DNA, 628 bp, Homo sapiens
  misc_feature: GZ8MTXP02IGEER.2.57.F02.1.454.CMB.2.raw
  modified_base (279)..(279): a, c, t, g, unknown or other
  misc_feature (279)..(279): n is a, c, g, or t
tcagacgctcgacacacgaccggtgctcgatttagctcgatatagttgggtttgggggcaggcgtcagactcagtcaggacacagcatggacatgagggtccccgctcagctcctagggctcctgctgctctggctcccaggtgccaaatgtgacacccagatgacccagtcctcctcccaccctgtctgcatcagtaggagacagagtcaccatcacttgccggcagtgagagtgttggcacttattggcctggtatcagcaataaaccgaggaaacnccccagaactcctgatctatgatcgcctccagtccgtggggaggggtcggggtccccccagtcgaaagggttcaaggtccggctaggtagacgttcgtacggggaactaggtaaactttccgaaccttctaccaaccctactaccaaacgacgaccttacgaccacgcccgtagtattacggttatttttacgaactttaaactttagttaccttagaccctaaagtagtttagtaggttagttaaacgttacgttccggtgggtaccgtcggtaccggaacgggggtacctaacgggttaagaaacgtaacgaaaacgtaacgttggtacggtacgtacgtacaaccg

SEQ ID NO: 313375 - DNA, 520 bp, Homo sapiens
  misc_feature: GZ8MTXP02FGHTW.2.57.F02.1.454.CMB.2.raw
  modified_base (277)..(277): a, c, t, g, unknown or other
  misc_feature (277)..(277): n is a, c, g, or t
  modified_base (513)..(513): a, c, t, g, unknown or other
  misc_feature (513)..(513): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctccaccctgtctgcatcagtaggagacagagtcaccatcacttgccgggccagtgagagtgtggtcactatttggcctggtatcagcataaaccagggaaanccccagaactcctgatctatgatgcctcagtctgggaggtggggtcccccatcaaggttcagcggcagtagatcgtgggacagaattcactctcaccatcaacagccctgcagccctgatgattttgactaactttatactcgaccaaactagtataggtaggtaaattagtccggtgggccgttcggccgtaggggaccgaaggtaggaaataacgaaacgtaaactggtaggcncgcaacc

SEQ ID NO: 313376 - DNA, 652 bp, Homo sapiens
  misc_feature: GZ8MTXP02HQWSJ.2.57.F02.1.454.CMB.2.raw
  modified_base (203)..(203): a, c, t, g, unknown or other
  misc_feature (203)..(203): n is a, c, g, or t
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
  modified_base (357)..(357): a, c, t, g, unknown or other
  misc_feature (357)..(357): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgaccacccagatgacccagtcctcctcccaccctgtctgcatcagtagganacagagtcacatcacttgccggcagtgagagtgtgcactagttgcctggtancagcaataaaccgaggaacnccccagaacctctagatctatgatgcctcgtagtcgtggggaggggtcgggtcccccagtaccgtaaggttcgaggccgganaggtagactacgtaggggaacagtaaactttccgactttaccacccaacctactaccaaacgtccgcccgtagacccagtcccttaggtactttaggtttactttttacgaacctttaaactttattaccgtacgaaccctaaacgtaggtttaagttaggggttaacggttttaaaagttaccggttccgggttacgggggttccggttaccgggaccgggtaacggggaaccgtaaggggtacgtaaaactaaccgaaaaggtaccgttggggacgtccgtaaggacctaccg

SEQ ID NO: 313377 - DNA, 732 bp, Homo sapiens
  misc_feature: GZ8MTXP02G2WIB.2.57.F02.1.454.CMB.2.raw
  modified_base (276)..(276): a, c, t, g, unknown or other
  misc_feature (276)..(276): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgttgcactattggcctggtatcagcaataaaccgaggaaacnccccagaaactcctgaatctatgatcgcctcagtcgtagggagggttcgggtaccccagtcgaaggttcgaggtccggactaggtagacgtacgtaggggaactaaggtaactttccaacttcccaacaaccctaacgtacccaaactacggcccttacgacctacggtaccctaggtacctttggttaaacctttttcggaaacccttaaaacgtttttacgttaaccttaccggaaacccctaaagttaacggtttaaaggtttaccgggggtttaaaggtttaaaaccttttacggggtccccggggtttaggggggttcccgttttaacccgggggaacccgggtaaaggggggtaaaccccgtaaaagggggtttaccgaaaaacgttaaacccggaaaaacggtaaccggttggggttaccgggactttaaccgggcccgtttaaaaccg

SEQ ID NO: 313378 - DNA, 613 bp, Homo sapiens
  misc_feature: GZ8MTXP02JNT1C.2.57.F02.1.454.CMB.2.raw
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaaccatcacttgccgggcagtgagagtgtgcactgttgctggtatcagcataacgaggaacncccagactcngatctatgatgccctcgagtcgtggggagggtcgggtaccccctagtacgaaggttccaggccggactagtagaactcgtaggggactaagtacttcgaactctaacaccatacaaacgtagccctagaccacggtcctaggtaacttggttacttttacgacttaaacctttntttaacncgtaacccaaaggttaagttggtaaggttaggttaaaattcggttccgggtaggggtcccgtttccgggaaccgggtaaaggggtaacccgtaagggtaacggaaaacttaaccggaaaacgtacggtggtaggacctcggaacctaaccg

SEQ ID NO: 313379 - DNA, 604 bp, Homo sapiens
  misc_feature: GZ8MTXP02FSJH4.2.57.F02.1.454.CMB.2.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (480)..(480): a, c, t, g, unknown or other
  misc_feature (480)..(480): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagagtcaccatcacttgccggcagtgagngtgtgtcatattggctgtatcagcaataacgaggaaacnccccagactcngatctatgatcgcctcgtagtcgtggggacggggtcggtacccctagtaccgaaggttccgaggtccggactaggtagacgttccgtaggggaactaaggtaactttccaccttacctacccaaacctataacccaaacgcgtccctagacccagtcctgtacttgtacttttacgacttaaactttataccgtanacctaataggttaagtggtaacggttaattcggtacgggtgggtcgttaccgggaccggtaacggggaaccggtaagtaggaaaacgtaacgaaaacgtacgtggtacgactacgacctaaccg

SEQ ID NO: 313380 - DNA, 632 bp, Homo sapiens
  misc_feature: GZ8MTXP02IJDXW.2.57.F02.1.454.CMB.2.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
  modified_base (404)..(404): a, c, t, g, unknown or other
  misc_feature (404)..(404): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacgttgccgggcagtgagagtgttgcacttgttggcctggtancagcaataaaccgaggaacnccccagactcanatctatgatcgcctcaggtcgtaggggacgggtcggtacccccagtcgaaggttcaggcggacaggttagagtccgtaggggaactagtaaacttccgactctaccaacctanacaacgacgtcctgaccagcctagtagttagttattttacgactttaaactttattaccgtcgaaccctaaagtaggttacgttagggttagttaaaacttcggttcccgggtaggggttccggttaccggaaccgggaaacgggggtaaacccgtaaagggttacggaaaaacgtaaaccggtaaaacggtacggttcgggtacggtaccgttacggaaccctaccg

SEQ ID NO: 313381 - DNA, 597 bp, Homo sapiens
  misc_feature: GZ8MTXP02H8BUW.2.57.F02.1.454.CMB.2.raw
  modified_base (200)..(200): a, c, t, g, unknown or other
  misc_feature (200)..(200): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtagganacagagtcacatcacttcggccggcagtgagagtgttgcactagttgcctgtatcanacataaaccgaggaaccncccaagactcctagactctatgactcgcctcgtagtcgtaggggacgggtcggtacccccagtcgtaagtcaggtcggacagtagagtcgtacgggatacgtaaacttccaccttcacaacctactaccgaactacggcctacggaccaacgtccgtaagtaacgttgttattttacgtaactaactttacgttactacgaacctaaagtagtacggttagggttaagttaacgttacgtccggggttagggtcggttaccggacggtaacggggaactagggtaacgaaataaccgaaaagtcgttgacgtctagaccacg

SEQ ID NO: 313382 - DNA, 588 bp, Homo sapiens
  misc_feature: GZ8MTXP02GENWP.2.57.F02.1.454.CMB.2.raw
  modified_base (399)..(399): a, c, t, g, unknown or other
  misc_feature (399)..(399): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggccagtgagagtgttggtcactattggcctggtatcagcaataaaccaggaaacgccccagaaactcctagatctatgatcgcctctagtctggacgggtcggggtccccagtcgaaggttcagcggcagtagatcgtagggacagtacttcactctacaccaatccaaacgtacnccctgacacgtcctgacttggtattttcgacctaaactttacttactactacaaacgtagttagtaggttagtaaaattcgtcccggttggggtcgttaccggaccggtaaacgggggaccgtaaaggggttaacgaaaacgttaaccgaaaacggtaacgttgggtacgtacgtccgtaactaacccg

SEQ ID NO: 313383 - DNA, 636 bp, Homo sapiens
  misc_feature: GZ8MTXP02G80UA.2.57.F02.1.454.CMB.2.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccacctgtctgcatcagtagganacagagtcacatcacttgccggcagtgagagtgttgtcactattggctggtatcagcaanaaaccaggaaacncccagactcngatctatgatcgcctcgagtcgtggggacgggtcgggtacccccagtacgtaaggttcgaggcggacgaggtagacgtcgtaggggaacagtaaacttcgaacttcaccaactatacaaactcgcctagactacgtccgtagtacttaggttatttttacggaactttaaactttagttaccgtacgaaccctaaaagttagtacggtttagggttaagttaaagtttacggttccgggtacggggtccgggttaaccgcccgggaaaagggggtaccttaaaaggggtacgggttaaaactaaaccgaaaacggttaaacggtgtccgggtactacccgggactaaacccg

SEQ ID NO: 313384 - DNA, 630 bp, Homo sapiens
  misc_feature: GZ8MTXP02G0Q3J.2.57.F02.1.454.CMB.2.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtagganacagagtcaccatcacttgccgggcagtgagngtgttggcactattggcctgtatcagcaataaaccgaggaaacgccccagaacctcagatctatgatcgcctcagtcgtgggaggggtcgggtacccccagtcgaaggttcaggtcgactaggtagagtcgtaggggactaagtaattccaacttctaccaaccataccaactacgcctgacctagccttaggattgttacttttagaaccttaaactttactaaccgtcgtaacccaaacgttgttaagttacgggttaagttaaagtttacggttccgggttagggggtacccggtttaccggggacccgggtaacgggggaaacccgtaaagggggtaacggtaaaacgtaaccgaaaacggaacgtttggaacgggtctacgaccgtaaccg

SEQ ID NO: 313385 - DNA, 568 bp, Homo sapiens
  misc_feature: GZ8MTXP02JWHUK.2.57.F02.1.454.CMB.2.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
  modified_base (436)..(436): a, c, t, g, unknown or other
  misc_feature (436)..(436): n is a, c, g, or t
tcagacgctcgacacacgaccggtgctcgatttagctcgatatagttggggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacgttcgccgggcagtgagagtgttggtcactagttggcctggtatcagacaataaaccgaggaaacgccccaagacctcctgatctatgatcgcctcagtcgtgggaggggttcggccccatacgagttcgaggcggnagtagatcgtaggaacagtacttcactctacaccatcaacacgcctgcagcctagatgttatttgacttaacttattacncgacaactagtagtagttaggttaatacgttcggtagggtcggttccggacggtaacggggaaccgtaaaggggtaacgtaaaagtaaccgaaaacggttaacggtggtacggtacgtacggaccgtaaccg

SEQ ID NO: 313386 - DNA, 644 bp, Homo sapiens
  misc_feature: GZ8MTXP02GTN8U.2.57.F02.1.454.CMB.2.raw
  modified_base (202)..(202): a, c, t, g, unknown or other
  misc_feature (202)..(202): n is a, c, g, or t
  modified_base (281)..(281): a, c, t, g, unknown or other
  misc_feature (281)..(281): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctccctcccaccctgtctgcatcagtagganacagagtcaccatcacttgccggcaggtgagagtgttggtcactattggcctggtatcagcaataaaccgagggaaacnccccaagaacctcctagatctatgatcgcctcagtcgtgggaggggtcggtacccccatcgaaggttcaggcggcaggtagatcgtaggggaactagtaattcaactctacaaccataccaaacgacgccctagaccaaggtccctaggtaacttggttaactttttacggaacctttaaaactttacgtttaaccgtcgtaacccaaaagttaggttaacgttggggttaagtttaaactttacggttccgggttgggggttcccggtttaccgggaaccgggtaacgggggaacctaaaaggggttacggaaaacgttaaccgaaaacggtaacgtcggtacggacttacggactaacccg

SEQ ID NO: 313387 - DNA, 638 bp, Homo sapiens
  misc_feature: GZ8MTXP02H3UTI.2.57.F02.1.454.CMB.2.raw
  modified_base (200)..(200): a, c, t, g, unknown or other
  misc_feature (200)..(200): n is a, c, g, or t
  modified_base (282)..(282): a, c, t, g, unknown or other
  misc_feature (282)..(282): n is a, c, g, or t
tcagacgctcgacacacgaccggtgctcgatttagctcgatatagttgggtttggggcaggcgtcagactcagtcaggacacagcatggacatgagggtccccgctcagctcctggggctcctgctgctctggctcccaggtgccaaatgtgacacccagatgacccagtcctcctcccacctgtctgcatcagtagganacagagtcacatcacttgccggcagtgagagtgttggcacttagttggcctggtatcgagacaagtaaaccgagggaaaccnccccgaagaacctccgtagactactatgactcgcctcagtcgtggggacgggtcggtaccccagtacgtaggtcgaggcggactagtagatcggtaggaacaggtaacttcgacctctacaccatacccaaagtacgacctgaccacgtcctagtattagtttactttacggtaaccttaaactttacttaccgtacgtaaacccgaaagtttaggttagttaggggttaagtttaaacgttaccggttcgggtacgggggttaccgttaccggaaccggggtaaggggaaacccgtaagggtaacgtaaaacgtaaccgaaaacggtcgttaggacggtcctacggtacctaacg

SEQ ID NO: 313388 - DNA, 617 bp, Homo sapiens
  misc_feature: GZ8MTXP02FZ20O.2.57.F02.1.454.CMB.2.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacttgccggcagtgagngtgtgtcactagttgctgtatcagcaataaacgaggaacncccaagactctagatctatgatcgcctcgtagtcggagggtaggggtcgggtacccctagtcgtaaggtcaggcggactaggtagagtcgtagggactaagtacttcactcctacaacctataccgaaacacggtcccctagaccacgtcctaggtaaatttcggtaatttttcgaactttaaactttactaacgtaccgacctaaagttacgttagttagggttaagttaaacttcggtccgggtgggtaccgttacggggaaccggtaacggggaaccgtaaaaggggacgtaaaacgtaaccgtaaaacggtacgtaggtcggtaccgtacgacctaaccg

SEQ ID NO: 313389 - DNA, 529 bp, Homo sapiens
  misc_feature: GZ8MTXP02HMZ6O.2.57.F02.1.454.CMB.2.raw
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggccagtgagagtgttggtcactattggcctggtatcagcataaaccagggaaacgccccaagaactcctgatctatgatgcctccagtcgtggagggtcgggtccccagtcgaaggttcaggccggacaggtagatcgtaggggacagaacttcactctcaccatcaaacagccctgacagcctgacttgtattttgactaactttatactgacctaagagtataggtagtaattacgtcggtggtcgttcggaccgagggaccgaaggtcgaaataacgaaacgtacgtgagccgtagtaccacg

SEQ ID NO: 313390 - DNA, 638 bp, Homo sapiens
  misc_feature: GZ8MTXP02IJPZF.2.57.F02.1.454.CMB.2.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (458)..(458): a, c, t, g, unknown or other
  misc_feature (458)..(458): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacttgccggcagtgagngtgtggtcactattggcctggtatcagcaactaaccgaggaaacgccccaagaacctcctgatctatgctcgcctcgagtcgtagggagggtcgggacccccagtacgtaaggttcaggcgcgaggtagctacggtcggggaacaggtaaactttcctactcctaaccctaatacaaaccgacgtccctaggtccaacggtcctaggtactttagttacgtttanacccttaaattaccgtttaccgtagacccccgtaaaagtaggttactaagggtttacggttaaactttacggcccggttagggggtcccttcggggaccgtaacgggggaaacctttaaagggggacaaaacgggttaccaaaacggttacgtaacggtcgtacgtacgacctaacgtac

SEQ ID NO: 313391 - DNA, 620 bp, Homo sapiens
  misc_feature: GZ8MTXP02FU41P.2.57.F02.1.454.CMB.2.raw
  modified_base (280)..(280): a, c, t, g, unknown or other
  misc_feature (280)..(280): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagagacagagtcacatcacgttgccggcagtgagagtgtgtcacttagttggcctggtatcagacaagtaaaccgaggaaacnccccaagacctcgtagactctatgactcgcctcgagtcgtggggtacgggtcggtacccccagtcgtaaggttcgaggccgagngtagntacgtagggacaagtaactccaacttcaccaacataccaaacgtcgcctagaccgtacgtcgtgttaattacgttattttacgactttaaactttattaaccgcgaacctaaagtagttagtaggttagttaaacgtttcgtccggggtaggggtccgttaccgggaccgggtaaacgggtaccgtaaagggttaaccgaaaacttaaccgaaaaccggtgttacgggacgtaccgtacggaccttaaccg

SEQ ID NO: 313392 - DNA, 571 bp, Homo sapiens
  misc_feature: GZ8MTXP02JHMPT.2.57.F02.1.454.CMB.2.raw
  modified_base (232)..(232): a, c, t, g, unknown or other
  misc_feature (232)..(232): n is a, c, g, or t
  modified_base (280)..(280): a, c, t, g, unknown or other
  misc_feature (280)..(280): n is a, c, g, or t
  modified_base (400)..(400): a, c, t, g, unknown or other
  misc_feature (400)..(400): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagngtgttggtcactagttggcctggtatcagcaataaaccgagggaaacnccccaagaacctcctgatctatgatcgcctcagtcgtggggaggggtcgggtcccccagtcgaaggttcaggcggcaggtagatcgtaggggaacagtattcactctaccacatcaaacncgcctgacagcctagtattgttatttcgacttaactttattactacgaacctaagtacgtagtagggttagttaaattcggtacggtgggtccggttaccggacggtaaacggggtaacctaagggtaactaaaacgtaacgaaaacgtacgtggtagctacgactaaccg

SEQ ID NO: 313393 - DNA, 773 bp, Homo sapiens
  misc_feature: GZ8MTXP02G6HFD.2.57.F02.1.454.CMB.2.raw
  modified_base (278)..(278): a, c, t, g, unknown or other
  misc_feature (278)..(278): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacaccagatgacccagtctcctcccacctgtctgcatcagtaggagacagagtcaccatcacttgccggcagtgagagtgttggtcactattggcctggtatcagcaataaaaccgagggaaacnccccaagaacctcctagatctatgatcgcctcagtcgtaggggacggggtcggggtacccccagttaccgtaaagggttcgaacggtccggactaagggttacgacgtttaccggtagggggaacctaaaggtaaacctttcccgaaaccgttcccttaaacccgaaaacccaacttaaccctaaaaacccgtacggcccccttaaggacccaaacggtccccttaagggtaaatttccggtttaaattttttacgggaaacctttaaaaaccgtttttacttttaaaacccgtcggtaaaaccccctaaaaacgtagggttttaaaacggtcggggtttaaaaggtttaaaacgtttaaccgttccggggttacgggggtaccgtttaccggggaaccggaaacgggggtaaccgtaaaaggggttaccggaaaaacgtaaaccgtaaaaacggtaaccggtaggtacggtaccgttacggaacccgtaaaccg

SEQ ID NO: 313394 - DNA, 671 bp, Homo sapiens
  misc_feature: GZ8MTXP02H4PJI.2.57.F02.1.454.CMB.2.raw
  modified_base (106)..(106): a, c, t, g, unknown or other
  misc_feature (106)..(106): n is a, c, g, or t
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
tcagacgctcgacacacgaccggtgctcgatttagctcgatatagttgggtttgggggcaggcgtcagactcagtcaggacacagcatggacatgagggtccccgntcagctcctggggctcctgctgctctggctcccaggtgccaaatgtgacacccagatgacccagtcctccctcccaccctgtctgcatcagtagganacagagtcaccatcacttcggccgggcaggtgagtagttgttggtcacttagttggctaggtatcagacaagtaaaccgagggaaaccnccccaagaacctccgtagtactctatcgatcgccttaccgaggttcgtggggtacggggtcggtacccccctagtaccgtaaggttcgaggtccggacgaggtcgtagtacggtaggggactaaggtaacttccaacttctaccaacctataccgaaagccgccctaggacctacgtccttaggtaagtttcgttaattttcgacctttaaaactttacgttaccgacgtaacctaaagttagttacggttagggtttaagttaaacgttcggttccgggtaggggtaccggtttaccggggaaccgggtaacggggtaaccgaaaagggttacggaaaacctaacgaaaacgttacgtgggtacgtacacgtacaacc

SEQ ID NO: 313395 - DNA, 551 bp, Homo sapiens
  misc_feature: GZ8MTXP02GXR8U.2.57.F02.1.454.CMB.2.raw
  modified_base (353)..(353): a, c, t, g, unknown or other
  misc_feature (353)..(353): n is a, c, g, or t
  modified_base (399)..(399): a, c, t, g, unknown or other
  misc_feature (399)..(399): n is a, c, g, or t
  modified_base (523)..(523): a, c, t, g, unknown or other
  misc_feature (523)..(523): n is a, c, g, or t
  modified_base (540)..(540): a, c, t, g, unknown or other
  misc_feature (540)..(540): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactattggcctggtatcagcaataaaccgaggaaacgccccaagaaacctcctagatctatgatgcctcagtcgtgggagggtcggggtccccagtcaaggtcaggcggnagtagagtcgtagggacaaggaacttcacttcacaccatacaaacncgcctgacagcctagtatgtaatttttcgactaaactttactacacgacccaaagtagttaatgggttaggttaaattcgtccggtggtcgttcggacgtaacggggacaaaggtacggaaaanaacgaaaacgtacgtgngtacacgacac

SEQ ID NO: 313396 - DNA, 715 bp, Homo sapiens
  misc_feature: GZ8MTXP02JPSXT.2.57.F02.1.454.CMB.2.raw
  modified_base (234)..(234): a, c, t, g, unknown or other
  misc_feature (234)..(234): n is a, c, g, or t
  modified_base (279)..(279): a, c, t, g, unknown or other
  misc_feature (279)..(279): n is a, c, g, or t
  modified_base (353)..(353): a, c, t, g, unknown or other
  misc_feature (353)..(353): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtccacatcacttggccgggcagtgagngtgttggcactattggctggtatcagcaataaaccgagggaaacnccccaagaacctcctagatctatgatcgcctcgagtcgtgggagggtcggtcccccagtcgaaggtcagcgganaggtagactgtagggactaagtaacttcaactcctaccaacctactaccaaacgtacgacccgtaggacccaacgttccgtaggtattaggttaatttttacggaacctttaaaacggttttactttaaaccttaccggtaaccctaaacggttaaacggtttaagggttacgggtttaaaggtttaaaacgttttaaccgggtttcccggggtttaaggggggttccccggttttaccgggggaacccgggttaaaccggggggtaaacccggtaaaacggggtttaacggggaaaaacttaaccggaaaaacccgggttaacgttacggggtacggtaaccgttcggacccttaaacccg

SEQ ID NO: 313397 - DNA, 579 bp, Homo sapiens
  misc_feature: GZ8MTXP02GEM5K.2.57.F02.1.454.CMB.2.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (276)..(276): a, c, t, g, unknown or other
  misc_feature (276)..(276): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccacctgtctgcatcagtagganacagagtcaccatcacttgccgggcagtgagngtgtgtcatagttgctggtatcagcaataaaccgaggaaacnccccaagacctccagatctatgatcgcctcgagtcgtggggaggggtcggtcccccagtcgaaggttcaggccggataggtagatcgtagggacaagtacttccactcctacaacctataccaaacacgcctagctagcctagattgtagttttacacttaactttactacgtacgaccaagtagtagttggtaagttaatacggtcggtcgggtaccggtttacgggaccggtaaggggaccgtaaaggggtacgtaaaagtaaccgaaaacgtacgttaggtcggtactacgacgtaaccg

SEQ ID NO: 313398 - DNA, 651 bp, Homo sapiens
  misc_feature: GZ8MTXP02GF7NP.2.57.F02.1.454.CMB.2.raw
  modified_base (285)..(285): a, c, t, g, unknown or other
  misc_feature (285)..(285): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtaggagacagagtcaccatcacttgccgggcagtgagtagtgttggtcacttagttggcctggtatcgagcaataaaccgagggaaacnccccaagaacctcctgatctatgatcgcctcagtcgtgggacggggtcgggtcccccagtccgaaggttcaggccggatagtagagtcgtaggggactaagtacttcgacctcctaccacctaataccaacacgcctagccaacgtcctagtacttggttattttacgacttaaacgttttactaacgtaccgaacctaaagtaggttaaggttagggttaacggtttaaacgtttacggtccgggggtttacggggtaccgggtttacccggggaccgggtaaacggggaacccgttaaaggggtaacggtaaaaactaaccgggtaaaaccgtaggtcgggttacggaccttacgaccgtaacc

SEQ ID NO: 313399 - DNA, 714 bp, Homo sapiens
  misc_feature: GZ8MTXP02FK3OK.2.57.F02.1.454.CMB.2.raw
  modified_base (236)..(236): a, c, t, g, unknown or other
  misc_feature (236)..(236): n is a, c, g, or t
  modified_base (290)..(290): a, c, t, g, unknown or other
  misc_feature (290)..(290): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcagtaggagacagagtcacatcacgttcgccggcagtgagngttgtggtctacttagttcggctggtatcagacaacgtaaaccgagggaaaccnccccaagaacctccgtagacttactatgactccgtccctacgtaagttccgaggggtacggggttccggggtacccctaacgttacggtaaacggttcgacggaccggtactagggtacgtacgttacggtacgggaacctaaggtaacttccgaaccttcctaacccacctaatacccaaacgtcgcctaggacctacgcgttagtacttaggttacttttacggaacctttaaacgtttacttaacacgaacccgtaaagtaggtttaaagttgggggaacttttaaagtcccgggttacggggttagggggtcccgtttaaccggggaaaccgggttaaacgggggaaaccttaaagggggtaataaaaacccgtaacggtaaaacccgttagacgggttcggaacctcggaaccctaacg

SEQ ID NO: 313400 - DNA, 582 bp, Homo sapiens
  misc_feature: GZ8MTXP02IUWBD.2.57.F02.1.454.CMB.2.raw
  modified_base (283)..(283): a, c, t, g, unknown or other
  misc_feature (283)..(283): n is a, c, g, or t
  modified_base (363)..(363): a, c, t, g, unknown or other
  misc_feature (363)..(363): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacaccagatgacccagtctcctcccaccctgtctgcatcagtagagacagagtcaccatcacttgccggcagtgagagtgttggtcacttattggctggtatcagacaagtaaaccgaggggaaaacccncccaagtaacctctagtatactatgactcgcctacgtagtcgtggggacgggtcggtacccagtacgtaggtcaggcganaggtacagtcgagactagtacttcactcacacatacaacgcgctgacacgtctagtattgttacttacgtaacttaacttactacgacgaacctaaagtaggttagtagggttaacgttacgttcggtacgggtcgggtacggtaccggaacgggaagggtaaccgtaaaggtaacgaaaactaacgtaaaacgtacgtcggacgtacgtacgactacg

SEQ ID NO: 313401 - DNA, 572 bp, Homo sapiens
  misc_feature: GZ8MTXP02JXGF8.2.57.F02.1.454.CMB.2.raw
  modified_base (201)..(201): a, c, t, g, unknown or other
  misc_feature (201)..(201): n is a, c, g, or t
  modified_base (418)..(418): a, c, t, g, unknown or other
  misc_feature (418)..(418): n is a, c, g, or t
  modified_base (462)..(462): a, c, t, g, unknown or other
  misc_feature (462)..(462): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccacctgtctgcatcagtagganacagagtcaccatcacttgccgggcagtgagagtgttggtcactattggcctggtatcagcaataaaccgagggaaacgccccagaactcctagatctatgatcgcctcagtcgtggggacggggtcgggtacccccagtcgtaaggttcgacggcggactaggtagactccggtagggactaagtaacttctaactcctacaacctataccaaacncgccctgaccagcctgtaatcgttatttcgactaacttattacncgaacctaagtagtagttgggtagtaaacttcggtaccggtagggtccgttacggccggaagggtaccgaagggtacgaaataacgaaacgtacgtcgagctacgactac

SEQ ID NO: 313402 - DNA, 594 bp, Homo sapiens
  misc_feature: GZ8MTXP02G9JBH.2.57.F02.1.454.CMB.2.raw
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagngtgtgtcatattggctggtatcagcaataaacgagggaaacnccccagaactcctagatctatgatcgcctcagtcgtgggacggggtcgggtcccccagtcgaaggttcaggcggcagtagactcgtaggggacaggtaacttcaactctacaacctatacaaacacggcctgaccaagcctaggaacttggtaattttcgaccttaaactttattaccagaccctaaagtgtaacttgggttagttaaaacttcgttccgggtagggtccggtttcgggaccggtaacgggggtaacctaaaggggtcgtaaaaactccgaaaacggtaacgttggtacgggtcctaggtaccctaaacg

SEQ ID NO: 313403 - DNA, 596 bp, Homo sapiens
  misc_feature: GZ8MTXP02I6SOG.2.57.F02.1.454.CMB.2.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (365)..(365): a, c, t, g, unknown or other
  misc_feature (365)..(365): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (580)..(580): a, c, t, g, unknown or other
  misc_feature (580)..(580): n is a, c, g, or t
  modified_base (587)..(587): a, c, t, g, unknown or other
  misc_feature (587)..(587): n is a, c, g, or t
tcagacgctcgacacacgaccggtgctcgatttagctcgatatagttggggtttgggggcaggcgtcagactcagtcaggacacagcatggacatgagggtccccgctcagctcctggggctcctgctgctctggctcccaggtgccaaatgtgaccacccagatgacccagtctcctcccaccctgtctgcatcagtagganacagagtcacatcacttgccggcagtnagngtgtgtcactattgctggtancagcaanaaccgaggaaacnccccanaactctagatctatgatcgccctcgagtcgtgggtacgggtcgggtcccccattccgaaagggttccaaggccggactagggtanacgtcgtaggggaactagtaacttcgacttctaccaaccaatccaaacgacgccctgacacgtacctagtacttgttaactttcgaacttaaacgttnttaacncgacctaataggttagaggtttagtaaacgtttcgtaccgggtgggtccggttccggaccggtaacggggtacctaaaaggggtcgaaaactaacgaaaaccgtagtcggngtaccgngaccctacg

SEQ ID NO: 313404 - DNA, 786 bp, Homo sapiens
  misc_feature: GZ8MTXP02G6B8P.2.57.F02.1.454.CMB.2.raw
  modified_base (620)..(620): a, c, t, g, unknown or other
  misc_feature (620)..(620): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccacctgtctgcatcagtaggagacagagtcaccatcacgttcggccgggctagtggagtaggttggttggtactacgttagtttcggccgttggtactcgaagactaaacgtaaaaccggagggaaaccctccccgaagaaaccttcctagtactcttagtacgactccgtacccgttaccgacggttcgggtacggggtacgggggttccggggtaccccccctagttaccggtaaacggggttccgacgggaccgggtacgtagggtacggtacgttaccggggttagggaaacgttaacgtaaactttccctaacccgtttcctaaacccgaaacctaaacgttaacccaaaccgaccgtcccgttggacctaacgggtccctaggttaaaccttggtttaaacttttcgtaacccttaattttaaccggttaaccncggtaaaccctaaggttaagttacggtttaagggttaaacgttagttacccggttccgggggtcggggtacccggttaccggggacgggtaaagggggtacccgaaacgggttaagggtaaaacctaacggtaaaaacgtggtcggtcggtctaacggacctaacg

SEQ ID NO: 313405 - DNA, 710 bp, Homo sapiens
  misc_feature: GZ8MTXP02HDDP3.2.57.F02.1.454.CMB.2.raw
  modified_base (303)..(303): a, c, t, g, unknown or other
  misc_feature (303)..(303): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagatcaccatcacgttgccggcagtgagtagtgttggtactacttagttggcctaggtatcgagacaactaaaccgaggaaaccaccccaagaacctccngtatactatgatcgcctcgagtcgtggggtacggggtcggtcccccagtacgtaaggtcgaggcggacgtaggtagtagtaccggtagggaactacgtaacttacccaccgtttcacccaaacctagtacccgaaaacgcgtccccgtggaacccctacgtccgttaaggtaaccgtttggtttaacttttacggaacctttaaaaccttttactttaacccggacgttaaaccctaaaggttacgtttaggttaaggggttacgttaaaacgtttcggtaccgggggttcggggtaccgggttacccgggaaacggggtaacgggggtaaaccgtaaaggggttaaccggaaaaccttaacggaaaacggttaccggttggtaccggacgtactacccgttaaacc

SEQ ID NO: 313406 - DNA, 528 bp, Homo sapiens
  misc_feature: GZ8MTXP02H4WJZ.2.57.F02.1.454.CMB.2.raw
  modified_base (201)..(201): a, c, t, g, unknown or other
  misc_feature (201)..(201): n is a, c, g, or t
  modified_base (410)..(410): a, c, t, g, unknown or other
  misc_feature (410)..(410): n is a, c, g, or t
  modified_base (443)..(443): a, c, t, g, unknown or other
  misc_feature (443)..(443): n is a, c, g, or t
  modified_base (513)..(513): a, c, t, g, unknown or other
  misc_feature (513)..(513): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccacctgtctgcatcagtagganacagagtcaaccatcacttgccgggcagtgagagtgttggcactattggcctggtatcagacaataaaaccgagggaaacgccccaagaaactccagatactatgatgccttcagtctaggggagggtcgggtcccccataccgaagttcaggcggcagtagatcgtagggaacagtaattcaacttcacacctataccaaacagcccngacacgtccagatgtattttgataactattacnaacatagtagtggtagtatcgtcgtggtcgtacgacggacggaacgaacggtagaaacaacgaaagacgngtacgctacgacacg

SEQ ID NO: 313407 - DNA, 605 bp, Homo sapiens
  misc_feature: GZ8MTXP02ICZ1H.2.57.F02.1.454.CMB.2.raw
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (317)..(317): a, c, t, g, unknown or other
  misc_feature (317)..(317): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacaccagatgacccagtctcctcccacctgtctgcatcagtaggagacagagtcacatcacgttggccggcagtgagtagtgttgtcactgttgctgtatcgagcaanaaacgaggaaacncccaagacctcngatacgtangatcncctacgagtcgtagggngggtcggccccagtcgaagtcgaagcgggactagtacgtataccggtagggaccaaggtaactttcaccttacactaaccaacgtaaccaagacgtacctgaccaacgtccgtagtattagtttactttacgaactttaaccgtttaattaccgtacgtaacctaaactagttagttaggtaagtttaacgttaacggttaccggtgggttaccggttacgaacggaacgggaacgtaaggtaacgtaaacgtaacgaaaaacgtgtacgacgtcgtacgactaaccg

SEQ ID NO: 313408 - DNA, 661 bp, Homo sapiens
  misc_feature: GZ8MTXP02HH1O7.2.57.F02.1.454.CMB.2.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgaccacccagactgacccagtcctcctcccaccctgtctgcatcagtagganacagacgtccacatcacttcgccgggcagtgagagtgttggtcacttagttcggccttaggtatcaagactaacgtaaaccgaagggaaaccnccccgaagtaacctcctagatactagtgactcgcctctaggtcgtaggggacgggttcggtcccccagttaccgaaggttcacggcggtacgaggtacgacgtacggttaggggaactaggtaaacttccgactttaccgacctaacctaacgtaccaaaacgcgtcccttaggacctaacgtcgttagtacttaggttatttacgattaacttacttacgacgtactaagtagttggttaggtaatttacggttacgtccgggtggtacccggttacgggaccggtaaacggggttaaccgaagggttaacgaaaacgtaaccgtaaaacggtcgttacggcggttaccaacggtccctaacg

SEQ ID NO: 313409 - DNA, 612 bp, Homo sapiens
  misc_feature: GZ8MTXP02G6F0A.2.57.F02.1.454.CMB.2.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (430)..(430): a, c, t, g, unknown or other
  misc_feature (430)..(430): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagagtcaccatcacgttggccggcagtgagagttgttggtctacttagttcggccttggtatcagacaacgtaaaaccgagggaaacnccccaagaacctcctagactctatgatcgcctcgagtcgtggggacgggtcgggtacccccagtaccgtaaggtcaggtcggactaggtagagtcgtagggactaagtacttccacttctaccaaccataccaaacncgcctagcacgtcctagtaattggttactttcgaacttaacgtttactacgtacgaacctaagtaggttagtacggttagtaaacttcggtcgggtagggtccgttacgggaccgggtaacgggtaacgaagggtacgtaaaacaacgtaaaacggtacgttaggtacgactacgactaccg

SEQ ID NO: 313410 - DNA, 558 bp, Homo sapiens
  misc_feature: GZ8MTXP02GNAOD.2.57.F02.1.454.CMB.2.raw
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (250)..(251): a, c, t, g, unknown or other
  misc_feature (250)..(251): n is a, c, g, or t
  modified_base (253)..(254): a, c, t, g, unknown or other
  misc_feature (253)..(254): n is a, c, g, or t
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtaggagacagagtcaccatcacttgccggcagtgagngtgtgcatntgctgannannanaacgaggaacncccagactctagatctangatcgcctcgtagtcgtggggacgggtcggtaccccagtacgaggtcaggcggactagtagactcgtagggacagtactcactctacacctatacaactcgccctagcctacgcctagtacgtttgtacttttacgacttaaactttataccacgaacctaagtagttagtaggttagttaacttcggtccgggtgggtccgtcgggaccgaaggggtaaccgaaggtaagaaaacgtaacgaaaacgtacgtgggacgctacggacctaacg

SEQ ID NO: 313411 - DNA, 571 bp, Homo sapiens
  misc_feature: GZ8MTXP02ICIKQ.2.57.F02.1.454.CMB.2.raw
  modified_base (202)..(202): a, c, t, g, unknown or other
  misc_feature (202)..(202): n is a, c, g, or t
  modified_base (279)..(279): a, c, t, g, unknown or other
  misc_feature (279)..(279): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacttgccggcagtgagagtgttgtcacttattggctggtatcagcaataaaccgagggaaacnccccagaactcctgatctatgatcgccttcagtcgtgggacggggtcgggtcccccagtcaaggttcaggcggctaggtagagtcgtaggggactagtacttcactcaccacatacaacacgcctgcagcctgattgttatttcgacttaacttatactcgacctaacgtagttagttggttaagttaacgttacggttccggtgggtccggttacgggaccggtaacggggtaccgtaaagggtagaaaacgtaacgtaaaacgtacgtggtacgtacgtacggacctacg

SEQ ID NO: 313412 - DNA, 546 bp, Homo sapiens
  misc_feature: GZ8MTXP02GZQ8E.2.57.F02.1.454.CMB.2.raw
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcactattggcctggtatcagcaataaaccgagggaaacgccccaagaacctcctagatctatgatgcctcagtcgtgggaggggtggtcccccagtcgaaggttcaggcggacaggtagatcgtaggacagtatcactctacacctatcaaactacgcctacgcacgacctggacttgtaattttgaactaactttattacacgtacaactagtacttggtagttaattacgtcggtggtcggttacggcgaacggggaccaagggtgaaaactcgaaaacgtacgtggtcggactcggactacg

SEQ ID NO: 313413 - DNA, 662 bp, Homo sapiens
  misc_feature: GZ8MTXP02JCWAU.2.57.F02.1.454.CMB.2.raw
  modified_base (202)..(202): a, c, t, g, unknown or other
  misc_feature (202)..(202): n is a, c, g, or t
  modified_base (286)..(286): a, c, t, g, unknown or other
  misc_feature (286)..(286): n is a, c, g, or t
  modified_base (367)..(367): a, c, t, g, unknown or other
  misc_feature (367)..(367): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccacctgtctgcatcagtagganacagatcaccatcacttgccgggcagtgagagtgttggtcacttagttggccttggtatcgagcaagtaaaccgagggaaaccnccccagaacctcctgatctatgactcgcctcagtcgtgggaggggtcggaccccatcgtaaggttcaggcggcaggtagtntacggtaggaacaacgtaaattcgaaccttcctaccaacctataacccaaacgtaccgaccctagacccgtacgtcctagtattaggtttactttacggacttaaactttacgttaacctcgtaaccctaagtacggttaagttagggttaaggtttaacttacggtttccgggtagggggttaccggttaccggggaccgggtaaacgggggtaaaccttaaacgggggtaacgtaaaaaccgtaacggaaaacggttaaccggtaggttccggacttaccggaccctaaaccg

SEQ ID NO: 313414 - DNA, 682 bp, Homo sapiens
  misc_feature: GZ8MTXP02HWPVA.2.57.F02.1.454.CMB.2.raw
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtaggagacagagtcaccatcacttgccgggccagtgagagtgttggtcacttattggcctggtatcagcaataaccgaggaacgccccaagaacctctgatctatgatgcctcagtcgtgggaggggtcggtccccagtcgaacggttcaggcggactaggtagacgtcggtagggaactagtaaattcccgaacttctacaccctatacccgaaactacgcccctagcccagtacccttggatttaggttactttttacggaacctttaaacgtttaacttacccgtaggtaacccctaaaagttaggttaagttcgggggttaagtttaaaacgtttccggtcccgggggttaggggtcccggtttacccggggaacccggggtaaacgggggttaaccgaaaacgggggtttaaggaaaaccgtttaaccgaaaaacccgggtacgtttaggggtccggtaccggtacggacccgtaaacccg

SEQ ID NO: 313415 - DNA, 601 bp, Homo sapiens
  misc_feature: GZ8MTXP02FGEUO.2.57.F02.1.454.CMB.2.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (283)..(283): a, c, t, g, unknown or other
  misc_feature (283)..(283): n is a, c, g, or t
  modified_base (323)..(323): a, c, t, g, unknown or other
  misc_feature (323)..(323): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccggaggtgccaaatgtgacacccagatgacccagtcctcctccaccctgtctgcatcagtagganacagagtcacatcacttgccgggcagtgagngttgtggtcatattggcctggtatcagacaagtaaaaccgagggaaacncccccaagaacctcctagattctatgatcgcctcagtcgngggtacgggtcgggaccccctagtacgaaggttcaggccggataggtacgagttcgtaggggaactaagtaacttaccgaacttcctaccaaccctaataccaaactaccgcctagacctagacctgaaacgttcgtaagttttacaaccttaaatttacgtactccgaacaacgttagtacgtaggtagttaatacgtcggtagggtccgttacggaccggacgggtaaccgaaggtagaaacgtaacgaaacggtaactggtacgacacgactaac

SEQ ID NO: 313416 - DNA, 712 bp, Homo sapiens
  misc_feature: GZ8MTXP02JSSE6.2.57.F02.1.454.CMB.2.raw
  modified_base (201)..(201): a, c, t, g, unknown or other
  misc_feature (201)..(201): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagganacagagtcacatcacttgccggcagtgagagtgttggtcactagttggcctggtatcagcataaaccgagggaaacccccaagaactccagatctatgatcgacctcagtcgtgggagggttcgggtcccccagtcgaaggttcaggcggacaggtagagttccgagggacctaaggtaactttcaaccttctacccaacctacttaccaaaaccgtacggccccctagggaccctaacggtccccgtaagttaccgttagtttaaacgtttttacggaacccctttaaaacttttaacttaacccgttacggaaaccccctaaagttaaagggtttaacggtttaggggtttaaccggtttaaaattaccgggttcccggggttaacgggggttcccggttaccgggggttaacccggaaacgggggtaacccgtaaaagggggttaccggaaaaacgttaaccgaaaaacggtaacgtttggggacgtaccgttacggaacctaacccg

SEQ ID NO: 313417 - DNA, 688 bp, Homo sapiens
  misc_feature: GZ8MTXP02GXG64.2.57.F02.1.454.CMB.2.raw
  modified_base (378)..(378): a, c, t, g, unknown or other
  misc_feature (378)..(378): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcacatcacttgccggcagtgagagtgttggtcactagttggcctggtatcagacaacgtaaaccgagggaaaaccgccccaagaaaccgttcctagactctatgtactcgtccctcagtcgtaggggacggggtcgggtaccccccagtccgtaaggttcgaggtccggnaggtagacgtcgtaggggacctaagtaacttcacgttcctaccgaacctactacaaacacgcccctgaccgagtcccgtagaacttggttaactttcggacctaaaacttttacgtttaacaccgtaaacccgtaaagttacggttagtttacggggtaagtttaaaagtttcccgggtaccgggttcgggggttaccggtttacccggggaccgggttaaacgggggtaaccgtaaagggggttaacgaaaacgttaacgtaaaaacccggtagttcggggtacggtaccgtacggtaaccgtaacccg

SEQ ID NO: 313418 - DNA, 563 bp, Homo sapiens
  misc_feature: GZ8MTXP02GABHL.2.57.F02.1.454.CMB.2.raw
  modified_base (274)..(274): a, c, t, g, unknown or other
  misc_feature (274)..(274): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgtgtcatattggctggtatcagcaataaaccgaggaaacnccccagaactcctgatctatgatcgcctcgagtcgtgggagggtcgggtcccccagtacgtaaggttcaggcggacagtagatcgtagggacagattcactctaccacatcaaacgcgcctgacagcctgtactgtactttgaacttaacgttatacncgacctaanagtttagtgggttagttaaaacttcggtccgggttacgggtcggttaccgggaccggaagggggtaacccaaaggggttcgaaaactaacgaaaaccgagttcggtacggactacgacctac

SEQ ID NO: 313419 - DNA, 655 bp, Homo sapiens
  misc_feature: GZ8MTXP02IK2YH.2.57.F02.1.454.CMB.2.raw
  modified_base (203)..(203): a, c, t, g, unknown or other
  misc_feature (203)..(203): n is a, c, g, or t
  modified_base (287)..(287): a, c, t, g, unknown or other
  misc_feature (287)..(287): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagacgtcaccatcacttgccgggccaggtgagtagtgttggtcacttattggctggtatcagacaataaaccgaggaaaccnccccaagaactacctgactctatgactcgcctcagtcgtggggacggggtcggtaccccagtaccgaaggttcaggccgganaggtanagtcgtagggactagtaaacttcactcaccacacacaacgagtccctggacacgtccgtgtaacttgttatttcgaacgttaactttacttacctacgaacctaaacgttggttaacgtaggtttaacggtaacgttttacggtcccgggttacgggggttacgttacccgggggaaacggtaaaccgggggtaaaccgtaaaagggggttaaccggtaaaaacttaaacggaaaaccggtaacgtttacggggaacggtcgtaccgacggttaaacccc

SEQ ID NO: 313420 - DNA, 656 bp, Homo sapiens
  misc_feature: GZ8MTXP02JMY5D.2.57.F02.1.454.CMB.2.raw
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcacatcacttgccggcagtgagagtgttgcactattgctgtatcagcaataaaccgaggaaacgccccaagaacctccgtagatctaagtgaactcgtccctacgtaggtccggtggggaacggggtccggggtaccccctagtacgtaaacgggtttccgacggcggtacagggtacgagtaccggtaggggaactaagtaacttccaacttacctacctaaaccatacccgaaacgacgtccctagaccacgtacctagtaattcgtttactttagaacctttaacttacttaacgttacgaccttaaagtacgttacgttaggttaagttaacttacggtaccgggttgggtaccggttaccgggacggaaacccgggggtataaacggggtaagtaaaacgtaacgaaaaccggttcggtagtccggtactcggacctaaaccg

SEQ ID NO: 313421 - DNA, 576 bp, Homo sapiens
  misc_feature: GZ8MTXP02HUSBY.2.57.F02.1.454.CMB.2.raw
  modified_base (359)..(359): a, c, t, g, unknown or other
  misc_feature (359)..(359): n is a, c, g, or t
  modified_base (399)..(399): a, c, t, g, unknown or other
  misc_feature (399)..(399): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggcagtgagagtgttggtcacttatttggcctggtatcagcataaaccgaggaaacgccccaagacctctagatctatgatcgcctccagtcgtggggacggggtgggccccccagtcgaaggttcaaggcggacnggtagatcgtaggggaacagtaattccactctaccactanacaacagcctgccagtcctagacttggttactttttcgacttaaccgtttatacctgaccctaaagtagtagtacgggttagtaacgtttacgtccgggtagggtccgttacggccgaacgggggtaccaaggttacggaaataaccgaaaacggtactgggtcgactcgactaccg

SEQ ID NO: 313422 - DNA, 616 bp, Homo sapiens
  misc_feature: GZ8MTXP02FHDMO.2.57.F02.1.454.CMB.2.raw
  modified_base (278)..(278): a, c, t, g, unknown or other
  misc_feature (278)..(278): n is a, c, g, or t
  modified_base (318)..(318): a, c, t, g, unknown or other
  misc_feature (318)..(318): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtaggagacagagtcacatcacttgccgggcagtgagagtgtggcatattggcctggtatcagcaataaaccgagggaaacnccccagaacctctagatctaatgatcgccctcgagttcgnggggacggggtcgggtacccccagtccgaaggttccaggcggcgagtagatcgtgggaacagacttcactctaccacactacaacacgcctagcgacgcctgaattgtaattttcggaacttaaacttttacttaacctcgtaacctaaacgttaaggttacgttagggttaacgtttaaacgttaacggttccgggttaggggtccggtttaccgggaccgggttaacggggaaccgtaagggtaacggaaacgtaaccgaaaacggtaacgtcggtacgtcgtaccgactaacccg

SEQ ID NO: 313423 - DNA, 795 bp, Homo sapiens
  misc_feature: GZ8MTXP02HIK1L.2.57.F02.1.454.CMB.2.raw
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtctccctcccaccctgtctgcatcagtaggagacagagtccaccatcacgttcggccggcaggtgagtagtgttgctattgttgcctggtatcagcaanaaacgagggaaaccnccccaagaacctccagtactactagtgactacgccctacgacggttcggtaggggacggggttcggggtacccccctaagtaccgtaaaggttccgaagggtccggactaggtacgtaagttccggtaaggggaacctaaagttaacttacctaaacgttcctaaacctaaaccctaactaaacccgaaaccgttaacccgtaccccgttacgaccgtaaccggtaccgttaaggtaacggtttacgtttaacgttttacgtaaaccttttaaacgtttaacgttaaccgttaaccggtaaaccttaaacggtttaaggttaacgggttttacgggtttaaaacggtttaaacggtttacccggggttaccggggttcgggggttacccgggtttaccggggaaaccgggggtaaacggggttaaaccggtaaaacgggtaaaccggtaaaacgttaaaacggtaaacggtaccggttacggtaccggtaccggtaacgtaaccctaacg

SEQ ID NO: 313424 - DNA, 673 bp, Homo sapiens
  misc_feature: GZ8MTXP02JR68V.2.57.F02.1.454.CMB.2.raw
  modified_base (638)..(638): a, c, t, g, unknown or other
  misc_feature (638)..(638): n is a, c, g, or t
  modified_base (666)..(666): a, c, t, g, unknown or other
  misc_feature (666)..(666): n is a, c, g, or t
tcagacgctcgacacacgaccggtgctcgatttagctcgatatagttgggtttgggggcaggcatcagactcagtcaggacacagcatggacatgagggtccccgctcagctcctggggctcctgctgctctggctcccaggtgccaaatgtgaccacccagatcgacccagtcctccctcccaccctgtctgcatcagtaggagacagacgtacacatcacgttcggcccggcagtgagtagtgtggtctagtgttcggctggtatcgagactaaacgtaaaccgaagggaaaccaccccgaagtaacctccgtagtaacttctagtcgtacgtcgtaccctaccgtaggttcggtaggggtacggggtcccggggtaccctagtacggtaacggttcggaacggtcggcgtaagttaacggacgttcgggtaaggggaactaagtaactttccgaaaccttccctaaccaaccagttaaacccgaaccgtcggaccctaggaccctacggtacttagtacgtttagttatttacccgaactttaaactttactacgacgtaaaccgtagtaggttagttaggtttagtaactcggtcggggtcggtccgtacggacggaacggggtacaagggtanaacgtaacgtaaacgtgtggtaccgacngtaaccc

SEQ ID NO: 313425 - DNA, 631 bp, Homo sapiens
  misc_feature: GZ8MTXP02GT7OM.2.57.F02.1.454.CMB.2.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtctccctcccaccctgtctgcatcagtagganacagagtcaccatcacttgccgggcagtgagngtgtgtcatattggctgtatcagcaataaaccgaggaaaccgaccccaagaacctccgtagattactagtgactcgtcctcgtacgttcgtggggtaggggttccggggtaccccctagtaccgtaaggttcgaacggcggtacgtaggtagacgtcgtacgggacaaggtactcactctacgacagacctaagcgtcctgccacgcgttgattacgtttagtttcgactttaaactttataccgtactaaccgtaaacgtaggttacgttagggttacgttaaaacgttcgttaccggggtgggtccggttaccgggaccggtaaacggggaccgtaaaggtacgaaaacgtaacgtaaaccggaacgttgggacggtacctacgggactacccg

SEQ ID NO: 313426 - DNA, 750 bp, Homo sapiens
  misc_feature: GZ8MTXP02IIGO8.2.57.F02.1.454.CMB.2.raw
  modified_base (200)..(200): a, c, t, g, unknown or other
  misc_feature (200)..(200): n is a, c, g, or t
  modified_base (244)..(244): a, c, t, g, unknown or other
  misc_feature (244)..(244): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctccaggtgccaaatgtgacaccagatgacccagtctccctcccaccctgtctgcatcagtagganacagagtcaccatcacttgccggcagtgagtagtgttgctattnttggctggtatcagcaataaaccgagggaaaccncccaagtacctcgtagactntatcgactccgtcctacgtaggtcggtaggggtacggggttaccggtcccctaagtaccggtaaggtcgacggtcggtacgtagggtacgtacgttacggtacgggaactaagtaacttacccaccgttaccaaccctaaacctacgtaaccgaaaccgtccgtcccgtacgaccgtaacgtccgttaggtaacgtttacgtttaacttttacgaaaccttttaaacgtttaccgttaaccgaaccgtaaacttaaaggttacgggttaacggtttaggggtttaaacggtttaaacgtttccgggggttacccgggggttacgggggttacccggttaccggggaaacccgggggtaaacggggttaaaccgtaaaaggggttaaccgtaaaaacggtaaaccggtaaaaccggttacggttcggtaccggtaccttacggaaccctaccg

SEQ ID NO: 313427 - DNA, 626 bp, Homo sapiens
  misc_feature: GZ8MTXP02IIIOI.2.57.F02.1.454.CMB.2.raw
  modified_base (202)..(202): a, c, t, g, unknown or other
  misc_feature (202)..(202): n is a, c, g, or t
  modified_base (283)..(283): a, c, t, g, unknown or other
  misc_feature (283)..(283): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacttgccgggcagtgagagtgttggtcacttattggcctggtatcagacaataaaccgagggaaacnccccagaacctccgagactctatgatcgcctcgagtcgtggggacggggtcggtacccccagtacgtaaggtcaggcggacnggtaanatcgtagggaactagaacttcacttcaccacataccaactcgtacctgactacgtccgtagtacgttagttcgttttacgaacctaagttttaactaaccgtcggaaaccctaaagtaggttaggtaaggttacgtttaaaacttcggttccggggtagggttaccgggttacgaccgggaaacgggggtaccgtaaaagggttaacgaaactaaacggaaaacgtacggttacggacgtctacggtaacaaccg

SEQ ID NO: 313428 - DNA, 607 bp, Homo sapiens
  misc_feature: GZ8MTXP02GRYD2.2.57.F02.1.454.CMB.2.raw
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccacctgtctgcatcagtaggagacagagtcaccatcacttgccggcagtgagngtgtgcatnttgctgatcagcataacaggaacncccanactctagatctangatcgcctacgngtcgtgggacgggtcggtacccctagtacgtaggttcacggcgtacgagttacgacgtccgtagggaactagtaactccgtaactctacacactacaacgacgccctaggcctaagtccctagtaattggttaacttttgacccttaaaatttcgttaaccgtagtaaccctaagttaagttaacggttggttaaacgggttaaactttcgggtaaccgggttcgggtaccggtttaccgggacgggtaaacgggtaaccgaaaggttacggaaaactcgaaaacggtactggtacggactacggacctaccg

SEQ ID NO: 313429 - DNA, 566 bp, Homo sapiens
  misc_feature: GZ8MTXP02HODOS.2.57.F02.1.454.CMB.2.raw
  modified_base (440)..(440): a, c, t, g, unknown or other
  misc_feature (440)..(440): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagtgttggtcactatttggcctggtatcagcaataaaccgagggaaacgccccaagaacctcctagatctatgatgcctcagtcgtgggaggggtcgggtccccccagtacgaaggttcaaggccggacaggtagagtcgtagggaactagaattcactctccaacatacaacagcctagcagcctagatgtatttcgactaacttnttacctgacccaagtagtagtggtacgtaattacgtccggtagggtcgttccggaccgaacgggggtaccaaggggttacgaaaactccgaaaacggtacgttggtacggtcgtacgacctaaccg

SEQ ID NO: 313430 - DNA, 604 bp, Homo sapiens
  misc_feature: GZ8MTXP02FQDKD.2.57.F02.1.454.CMB.2.raw
  modified_base (203)..(203): a, c, t, g, unknown or other
  misc_feature (203)..(203): n is a, c, g, or t
  modified_base (286)..(286): a, c, t, g, unknown or other
  misc_feature (286)..(286): n is a, c, g, or t
  modified_base (366)..(366): a, c, t, g, unknown or other
  misc_feature (366)..(366): n is a, c, g, or t
  modified_base (425)..(425): a, c, t, g, unknown or other
  misc_feature (425)..(425): n is a, c, g, or t
tcagacgctcgacacacgaccggtgctcgatttagctcgatatagttgggtttgggggcaggcgtcagactcagtcaggacacagcatggacatggagggtccccgctcagctcctggggctcctgctgctctggctcccaggtgccaaatgtgacacccagatgacccagtcctcctcccaccctgtctgcatcagtagganacagacgtcaccatcacttgccggcagtgagagttgtggtacacttattggcctggtactcagacaactaaaccgaggaaacnccccaagacctcagatctatgactcgcctcgtagtcgtggggtagggtcggtacccctatcgtaaggttcgaggcgtacnggtagacgtcgtagggactaagtactccgactcgtacactactacaacgtacgccgtanacgacgtacctgacttattctttacgaccttaactttactaactacgacctaagtaggttaagtcggttagttaaagttcgtacgggtagggtccgttacggtccggaaacggggaccgtaaagggtacgtaaaacgtaacgaaaaccggttacgaggtacggcgttaccgccgtaacg

SEQ ID NO: 313431 - DNA, 657 bp, Homo sapiens
  misc_feature: GZ8MTXP02GXR76.2.57.F02.1.454.CMB.2.raw
  modified_base (202)..(202): a, c, t, g, unknown or other
  misc_feature (202)..(202): n is a, c, g, or t
  modified_base (254)..(254): a, c, t, g, unknown or other
  misc_feature (254)..(254): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctcctcccacctgtctgcatcagtagganacagacgtcacatcacgttcgccggcagtgagtgtgtgtcatgtggctgtancagcaataaaccgaggaaaccccaagacctcagatctatgactcgcctcgtaggtcgtggggacggggtcggacccctagtaccgtaaggtcgaggtcgactagtcgaagttcggaggaacagtaacttcaaccttctaaccaacactaccaaacgtcgcccgagacccgtataccgtagttaacgtgtttaagttttacgaacctttaaacttttaactaccgacggttaaacccaaaaggtttaggttacggtttagggggtaagtttttaaaacgttaccgggttccccgggggttgggttacccggttaccgggaaccggggaaacggggtaacccggtaaaaggggaacgttaaaacgaaccgtaaaggtaaccggttggccgtacgtcaaccggtac

SEQ ID NO: 313432 - DNA, 568 bp, Homo sapiens
  misc_feature: GZ8MTXP02FF842.2.57.F02.1.454.CMB.2.raw
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtaggagacagagtcaccatcacttgccggccagtgagagtgtggtcactagttggcctggtatcagcaataaacccgaggggaaacgacccccaagaacctcctagtatctatgatcgcctccgtagtcgtggggtaggggtcgggtcccccagtacgaaggtcgaggcggagtagtagatcgtagggacagtaacttcaactctacacatacaacncgcctgacncgcctagattgtatttcgacttaactttatacgtacgaccaagtagttagtggtagttaattacgtcggtgggtccggttcggacggtaacggggacgtaaggacgaaactaacgaaaacgtacgtacggtcgactcgacctaacg

SEQ ID NO: 313433 - DNA, 623 bp, Homo sapiens
  misc_feature: GZ8MTXP02J2DLD.2.57.F02.1.454.CMB.2.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtccaccatcacgttggcccgggtcagtgagtagttgttggtctacttagttcggcctggtactcagacaagtaaaccgagggaaaccnccccaagaacctctagactctatgatcgcctacagtcgtagggcggggtcggtccccagtcgaaggtcagcgangtagngtcgaggactagtactcgacttctacactatacaacgcgacctgacacgtcctagtagtttacggttactttgaaaccctttaattaccgttaaccgacaaccgtaaaacgtaggtttacgtagggttaaacgtttaacgttcgtccggggtagggtacccggtaccgggacggaaacggggtaacgtaaacggggtaacgtaaaacgaaccgtaaaacggtaggtcggtacggtacacggacttacg

SEQ ID NO: 313434 - DNA, 546 bp, Homo sapiens
  misc_feature: GZ8MTXP02H7JTT.2.57.F02.1.454.CMB.2.raw
  modified_base (185)..(185): a, c, t, g, unknown or other
  misc_feature (185)..(185): n is a, c, g, or t
  modified_base (400)..(400): a, c, t, g, unknown or other
  misc_feature (400)..(400): n is a, c, g, or t
tcagacgctcgacacacgaccggtgctcgatttagctcgatatagttgggtttgggggcaggcgtcagactcagtcaggacacagcatggacatgagggtcccccgctcagctcctggggctcctgctgctctggctcccaggtgccaaatgtgacacccagatgacccagtctcctcccacctntctgcatcagtaggagacagagtcaccatcacttgccggcagtgagagtgttggtcactattgcctggtatcagacaataaacgaggaaacgccccaagaacctctgatctatgatgcctcagtcgtaggggagggtgggtcccccagtacgaaggtcaggcggcagtagatacgtagggaatagtaaattcaacttcacacccataccaacacncctagcacgtcctagatttgtattttacgacttaaactttataactcgaacctaagtagtagttaggtagttaattcgtacggtgggtcgttcggacggaaggaccgaagggagtaaacaagaacgaagtcggtagtcacgccacg

SEQ ID NO: 313435 - DNA, 725 bp, Homo sapiens
  misc_feature: GZ8MTXP02GUP0W.2.57.F02.1.454.CMB.2.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (329)..(329): a, c, t, g, unknown or other
  misc_feature (329)..(329): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagagtccaccatcacgttcggccggcaggtgagtagtgttggtctacttagttcggctaggtatcagacaaataaaccgagggaaacnccccaagaacctccagtatactatgtatcgcctcgnggtcggtggggacggggtcggtaccccctagttacgtaaggttccgaggtccgaatagggtagacgttacgggagggactaaggtaactttccaacgtcctaaccacctaactaacccgaaactcggtccctaggacccaacggtccttagtaatttaccggtttaaatttttcggaaccttaaactttagttaccaccgtaaaccgtaagtttaggttaacgttacggggttaagtttaaaacgttcggtcccggggttgggggttaaccggtttccgggaaacccgggtaaaacggggggtaacttaaaaacgggggtaacggttaaaaccaaaacggttaaaacccggggaacgttaggggttcggacccgtttacggaaccccctttaacgg

SEQ ID NO: 313436 - DNA, 643 bp, Homo sapiens
  misc_feature: GZ8MTXP02FJYL5.2.57.F02.1.454.CMB.2.raw
  modified_base (202)..(202): a, c, t, g, unknown or other
  misc_feature (202)..(202): n is a, c, g, or t
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctcccaccctgtctgcatcagtagganacagagtcaccatcacttgccggcagtgagagtgtgcactattggctggtancagcaactaaaccgagggaaacnccccaagaactccgtagactctaagtgactcgccctacgaggttccgaggggtacggggtcgggtaccccccagttacgtaaggttccgaggccgggactagtaggacgttaccgtaggggaacctaggtaactttccgaaccttctaacccaacattaaccaaacgtcgaccgtcggactaacgcctagtacgttgttacttttcgaacctttaaactttcttaacgaccgaacccgtaaagtagtttaacgtgggtaaagtttaactacggtccgggttcgggtacgttccgggacggtaaacggggtaccgaaaggggtacgaaactaacggaacgtaacggttgacggtactcggacctacg

SEQ ID NO: 313437 - DNA, 638 bp, Homo sapiens
  misc_feature: GZ8MTXP02GA7DG.2.57.F02.1.454.CMB.2.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (465)..(465): a, c, t, g, unknown or other
  misc_feature (465)..(465): n is a, c, g, or t
  modified_base (476)..(476): a, c, t, g, unknown or other
  misc_feature (476)..(476): n is a, c, g, or t
  modified_base (488)..(488): a, c, t, g, unknown or other
  misc_feature (488)..(488): n is a, c, g, or t
  modified_base (632)..(632): a, c, t, g, unknown or other
  misc_feature (632)..(632): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgacccagtcctccctcccaccctgtctgcatcagtaganacagatccacatcacttcggccggcagtgagtagttggtgtactacttagttcggcctaggtactccgagtaccaaacgtaaaaccggacgggaaaaccncccccgaaagaaccttcctagtactatagtcgatccgacctcgacgtcgtaggggtacggggtccggtcccccaagttcggaacggtccgacggcgggactagggtacagttcggagggaactaacgtaactcctaactcctaccaacctagtcccaaagcncgtagccgtanacgtgtacgttnttacgttcaacttacttatacgactactaagtagttagtaggttataacgttcggtaccggggtcggtaccgtccgggaacgggaacgggtaacgtaaagggtaacgtaaacgtaaccgtaaacgcgttggaccgacgtacccnctaacg

SEQ ID NO: 313438 - DNA, 679 bp, Homo sapiens
  misc_feature: GZ8MTXP02JZQPN.2.57.F02.1.454.CMB.2.raw
  modified_base (665)..(665): a, c, t, g, unknown or other
  misc_feature (665)..(665): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctccccaccctgtctgcatcagtaggagacagagtcaccatcacttcgccggcagtgagtgtgttggtctattagttcggcctggtatcgagacaagtaaaccgagggaaaccgccccaagaacctcctagatctatcgactcgtccctacgaggttcgtggggtacggggtccggtaccccccagttaccgtaacgggttacgaggcgggactagggtacgtacgtcggtagggaactaagtacttcgacctctaccaccactaccgaaacgtcgtccacgacgtacgtaccgttagttagttagtttacgttactaatttaacctttctacgaccgtaaacgtagtaggttacgggtacgtttagttaaaccggttccgggttccggggtacggggttaccgccgggggtaaacggtaacggggtaaaccggtaaggtttaaaccggaaaccgtaaccgtaaaccggttcggtacggcggttacccncggaacctttaccg

SEQ ID NO: 313439 - DNA, 628 bp, Homo sapiens
  misc_feature: GZ8MTXP02GO0K9.2.57.F02.1.454.CMB.2.raw
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
  modified_base (584)..(584): a, c, t, g, unknown or other
  misc_feature (584)..(584): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacaccagatcgacccagtcctcctcccacctgtctgcatcagtaggananagacgtacactatctacgtcggccggacaggtgagtagttggttgtactacttagtcgtcgttagtcacagacaacgaaacgaacggaaccaccgaagtacctcgagtactactagtgactccgacctacgtagtcggtggggtacgggttccggtaccctagtaccggttaacgtcgacggccgtaggtagtacgtagtacggagtacaaaggtacttcctaactcctacctaacacctaaacgaaacgtccggtcacgacgacgtacagttagttacttacgtttactacttactttacgacgtaacgaactaagttagtagtaggttaagttactcggtcggtaggtcgtacggacggtaacgggacgttaaaacggngtaaaaccgtaacgaacgtaccgtggactcggactacccgtacg

SEQ ID NO: 313440 - DNA, 703 bp, Homo sapiens
  misc_feature: GZ8MTXP02HH1H1.2.57.F02.1.454.CMB.2.raw
  modified_base (202)..(202): a, c, t, g, unknown or other
  misc_feature (202)..(202): n is a, c, g, or t
  modified_base (460)..(460): a, c, t, g, unknown or other
  misc_feature (460)..(460): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatcgaccagtcctcctcccacctgtctgcatcaggtagganacagacgtcaccatcacttcggccggcagtcgagtgttgtgactacttagttcggccttaggtactacacgactaaacgtaaacccgaggggaaaccctccccgaagaaccttccgtagtacttaccgtagtcggtaactcccggacccttacgtacggttccggtagggggaccggggtttcggaccccccgtaagtacggttaacggtcgaacggtcggataggtcgagtcggtaggactaagtacttccgacctnaccctaacacaccgtaaacctcgcctagaccgtcgtacctaagtactacggtttattacgttaccttaaaggtttactaccgtacgtaaccgttaaagtggttaacgtttgggttaaagtttacggtacggttccgggtacggggttaccgttaccgggaacgggttaacgggaaaccgttaaagggtacggtaaaacgtaacccggaaaagtccgtggtaacggcctaacggaccttaacgg

SEQ ID NO: 313441 - DNA, 669 bp, Homo sapiens
  misc_feature: GZ8MTXP02I97OL.2.57.F02.1.454.CMB.2.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
  modified_base (436)..(436): a, c, t, g, unknown or other
  misc_feature (436)..(436): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccaccctgtctgcatcagtagganacagagtcaccatcacttcggccgggccagtgagtagtgttggtcacttagtttcggccttggtactcgagacaacgtaaaccgaagggaaaccnccccaagaacctcctagactctatgatcgccctcgtagtcgtggggacggggtcggtaccccagtacgtaaggttcaggcgagtggtagagtcgtaggaactaagtaacttcaacctctacaaccctatacccgaacncgccctagctacgtcctagtatttgttaactttacgaacctttaaactttacgttaccgacgtaacctaaaggttagttaagttaggggttaagtttaaaacgtttcgggttcccggggttaggggttacccggtttccggggaaaccgggaacggggttaaccgaaaggggttaacgaaaacgttaaccggaaaaccgtacggttaggtaccggtacgtcgaaccttaacgg

SEQ ID NO: 313442 - DNA, 599 bp, Homo sapiens
  misc_feature: GZ8MTXP02F05R2.2.57.F02.1.454.CMB.2.raw
  modified_base (278)..(278): a, c, t, g, unknown or other
  misc_feature (278)..(278): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
  modified_base (354)..(354): a, c, t, g, unknown or other
  misc_feature (354)..(354): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccggcagtgagagtgtggtcacttattggcctggtatcagcaataaaccgaggaaacnccccaagaacctcctgatctatgatcgcctcagtcgngggnggggtcggtcccccagtcgaaggttcgagccgacnggtagatcgtagggacagaacttcactctacacatcaaacgtgccctgcacgctagagttgtattttacgacttaactttagttacctagaaccctaagtaggttagttgggtaagtttaaacttcggtccgggttggggtcccggtttaccgggacggtaacgggggtaaccgtaaaagggttacggtaaaaacgaaccgtaaaaaccggtaagtcgggtagtacccgtacggacccttaaacg

SEQ ID NO: 313443 - DNA, 709 bp, Homo sapiens
  misc_feature: GZ8MTXP02IQUFU.2.57.F02.1.454.CMB.2.raw
  modified_base (202)..(202): a, c, t, g, unknown or other
  misc_feature (202)..(202): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctccctcccacctgtctgcatcagtagganacagagtcaccatcacttggccggcagtgagtagtgttggcattgttgctgtancagcaataaaccgaggaacncccaagaactccagatctatgatcgccctcgtagtcgtgggtacggggtcggtacccccagtaccgaaggttccaggtacggactaggtacgtagtccggtaagggacctaagtacttccaacttctacccgaacataccgaaacgcgtccctagaccgtagtcctaggttaatttacggtttaaacgttttacgtaaacttaaaacgttttactttaaaccgaccggtaaacccttaaaaggttaggttaaacgggttttaggggttaaaccgttttaaacgtaaccgggtttcccgggggttaacgggggttcccggttaaccgggggaaccggggtaaacgggggttaaaacccgaaagggttaaccgtaaaaacgtaaccggtaaaaaccggtggttcggtaccggtaccgaacgtacccgttaaaccg

SEQ ID NO: 313444 - DNA, 597 bp, Homo sapiens
  misc_feature: GZ8MTXP02FHHZX.2.57.F02.1.454.CMB.2.raw
  modified_base (281)..(281): a, c, t, g, unknown or other
  misc_feature (281)..(281): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtaggagacagagtcaccatcacttgccgggccagtgagagttgtggtcactattggcctggtatcagcaataaaccgagggaaacnccccagaaacctcctagatctatgatgcctctagtcgtgggacggggtcggggccccccagttccgaaaggtttcaaggccggactaggtagactcgtaggggaactaaggaaatttccaactctaccaccatccaaacacgccctgcagcctgattgtattttcgactaacttattactcgaccaactagttactgggtagttaattacgtccggtgggcggttaccggacggtaacgggggtaaccgtaaaggggtacggtaaaacgtaaccgaaaacggtaaacgttgggtacggacgtacggacctaaaccg

SEQ ID NO: 313445 - DNA, 738 bp, Homo sapiens
  misc_feature: GZ8MTXP02G1HXZ.2.57.F02.1.454.CMB.2.raw
  modified_base (278)..(278): a, c, t, g, unknown or other
  misc_feature (278)..(278): n is a, c, g, or t
  modified_base (300)..(300): a, c, t, g, unknown or other
  misc_feature (300)..(300): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtctcctcccaccctgtctgcatcagtagagacagagtcacatcactggccggcaggtgagagtgttggctactattggctggtatcagacaataaaccgagggaaacncccagaactccgtgactctagngtatcgtaccctaccaggttcgttgggggacggggttcggggacccccctagtaccgtaaacggttcgaacgggtccgggaacgtagggttaagaaggttaccgtagggggtaaaaccaagggtaaactttacctaaacccgtaccttacccgaaaccctaacgttaaaccaaaacccgtaacggccccttaacggaccaaaccggtcccgttagggaaactttcgttaaagtttttcggaacctttaaacctttaaacgttacctaacggtacccaaacttaagtacggttaggttaagttaaacgttagtaccggttacgggggtcccggttaacgggaccgggtaaacgggggtaacccggtaaagggtaacgggtaaaacgtaacgtaaaaccgaaccggttacggaaggtcccgtaacggtacctaaacccgg

SEQ ID NO: 313446 - DNA, 608 bp, Homo sapiens
  misc_feature: GZ8MTXP02G4OWZ.2.57.F02.1.454.CMB.2.raw
  modified_base (201)..(201): a, c, t, g, unknown or other
  misc_feature (201)..(201): n is a, c, g, or t
  modified_base (277)..(277): a, c, t, g, unknown or other
  misc_feature (277)..(277): n is a, c, g, or t
  modified_base (395)..(395): a, c, t, g, unknown or other
  misc_feature (395)..(395): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacacccagatgacccagtcctcctccaccctgtctgcatcagtagganacagagtcaccatcacttgccggcagtgagagtgtgtcactgttgcctgtatcagacaagtaaaccgaggaaaccnccccaagaacctcctagatctatgactcgcctcagtcgtgggagggtcggtccccagtcgaggtcaggcgctagtacagtcgagggacagtaattccactctaccaacatacaaacgngtccctagaccaacgtcctagtaacttgttaacttttagaacccttaaacgttttattaaaccgaccgtaaccctaaagttaggttacgttagggttaacgttaaaacgttcggttacccggggtggggttacccgttacggggaaccggttaacgggggaacaaaggggttacgaaaacttaacgaaaacgtgtacggtgactacgactacg

SEQ ID NO: 313447 - DNA, 567 bp, Homo sapiens
  misc_feature: GZ8MTXP02IOQBY.2.57.F02.1.454.CMB.2.raw
  modified_base (199)..(199): a, c, t, g, unknown or other
  misc_feature (199)..(199): n is a, c, g, or t
  modified_base (276)..(276): a, c, t, g, unknown or other
  misc_feature (276)..(276): n is a, c, g, or t
  modified_base (397)..(397): a, c, t, g, unknown or other
  misc_feature (397)..(397): n is a, c, g, or t
  modified_base (528)..(528): a, c, t, g, unknown or other
  misc_feature (528)..(528): n is a, c, g, or t
tcagacgctcgacacacgaccggtgctcgatttagctcgatatagttgggtttgggggcaggcgtcagactcagtcaggacacagcatggacatgagggtccccgctcagctcctggggctcctgctgctctggctcccaggtgccaaatgtgacaccagatgacccagtctcctcccacctgtctgcatcagtagganacagagtcacatcacttgccggcagtgagagtgttggcacttattggcctggtatcagcaataaaccgagggaaacnccccaagaactcctagatctatcgatcgcctcagtcgtggggagggtcggtacccccatcgaaggtcacgcggcagttacgatcgtaggactagaattcaacgtctacaaccataccaaancgcctgacagtccatagttgtacttttgacttaaacgtttattaccgcgacctaataggttatagggtaggttaactacggtcggtagggtccgttacggccgaaacggggtacaaaggtacggtaaaacncgtaaaacggtacgttaggcggacttacggacctaaacc

SEQ ID NO: 313448 - DNA, 603 bp, Homo sapiens
  misc_feature: GZ8MTXP02HXEZG.2.57.F02.1.454.CMB.2.raw
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (413)..(413): a, c, t, g, unknown or other
  misc_feature (413)..(413): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
tcagacgctcgacacacgaccggtgctcgatttagctcgatatagttggggtttgggggcaggcgtcagactcagtcaggacacagcatggacatgagggtccccgctcagctcctggggctcctgctgctctggctcccaggtgccaaatgtgaccacccagatgacccagtcctcctcccaccctgtctgcatcagtagganacagagtcacatcacgttggccggcagtgagtgtgtgtcatnttgctgtancagcaataaaccgagggaaccnccccaagtaacctctagtactctaatgactgacctccagtcgagggacgggtcggtcccctagtacgaaggttcagcggactaggtagagtcgagggaccaaggtaacttccgactactcaacctagactaaacgngtccctgacctacgtctagacttagttctttagacttaacgttntaaccncgaacctaagttagtaggttacggttagttaacttacggtcggtgggttaccgtacgggaccggtaaacgggtacgtaaagggtaacgtaaaacttaacggaaaacggttacgtgggtaaccgccgttacgaccctaacg

SEQ ID NO: 313449 - DNA, 556 bp, Homo sapiens
  misc_feature: GZ8MTXP01DEQ7T.13.55.E11.1.454.CMB.2.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagagtcaccatcacttgccgggcaagtcagagcattaccaactattgaattggtanacaaacaaaaccagganacgcccctcacctccttatctatggtgcatccaccttaacaaagtcgggtacccatcaaggttcagtggcactggatctgggaacagtatttcactctcaccatcagcagtctgacaaaccttgaagtatttagactaaactttattactggtacaaacgtagtagtttcaagtcgcggtaacgttcggccgaagggaaccgaaaggtaaggaaacgttacgaaaaccgttagtaggtggacttcgacaaccatcttacgtcttactaacgttccttaaccccg

SEQ ID NO: 313450 - DNA, 524 bp, Homo sapiens
  misc_feature: GZ8MTXP01AB615.13.55.E11.1.454.CMB.2.raw
  modified_base (221)..(221): a, c, t, g, unknown or other
  misc_feature (221)..(221): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (360)..(360): a, c, t, g, unknown or other
  misc_feature (360)..(360): n is a, c, g, or t
  modified_base (506)..(506): a, c, t, g, unknown or other
  misc_feature (506)..(506): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgtatctgtaggagacagagtcaccatcacttgccggnaagtcagagcattaccaattattgaattggtatcaaacaaaaccnggganacgcccctcacctccttatctatggtgcatccaccttacaaagtcggggtacccatcaaggttcagtcggcacgtggatcgtagggacngtatttcactctcaccatcagcagtctgacaacctgaagtattttgactaacttatactgtacaacagtatttcagtacgcgacgttcgaccgaagggaccaaggtggaaactcgaaacgaacttggtaggcttgcacctaatctntctcattccttccgaacc

SEQ ID NO: 313451 - DNA, 573 bp, Homo sapiens
  misc_feature: GZ8MTXP01A0N33.13.55.E11.1.454.CMB.2.raw
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggcagtatttcactctcacatcagcagtctgcaacctgaagtattttgactaaactttattaacctggtacaaacgtagtacgtttcaacggttacgacgggtaccgtttcggacccgtaaaggggtaaccccgaaagggttaaggaaaagttcaaaaccgttaacgtaggtaggacgttcggacaacccagttaacctgttcttactaacttccgttccccg

SEQ ID NO: 313452 - DNA, 515 bp, Homo sapiens
  misc_feature: GZ8MTXP01B7RV6.13.55.E11.1.454.CMB.2.raw
  modified_base (294)..(294): a, c, t, g, unknown or other
  misc_feature (294)..(294): n is a, c, g, or t
  modified_base (320)..(320): a, c, t, g, unknown or other
  misc_feature (320)..(320): n is a, c, g, or t
  modified_base (385)..(385): a, c, t, g, unknown or other
  misc_feature (385)..(385): n is a, c, g, or t
  modified_base (480)..(480): a, c, t, g, unknown or other
  misc_feature (480)..(480): n is a, c, g, or t
  modified_base (507)..(507): a, c, t, g, unknown or other
  misc_feature (507)..(507): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggatttcctttggctatttaaaggtgtccagtgtgaagtgcagctggtggagtcgtgggggaggcttggtacagcctggcaggtccctgagactctcctgtgcagcctctggattcaccttgatgattatgccatgcactgggtccgnaagctcagggaggcctggagtggctnaggtattagtggatagtgtagcatggctagtgcggactcgtgtgagggcgatcacatctacaganacaacgccctaaagaactccctaggtactctagacaaatgaaacagccctgagagccgtggaaggacacgggtccttgtattattgttgacaaantaaccctaaccccttagattttaaggngtttaagg

SEQ ID NO: 313453 - DNA, 580 bp, Homo sapiens
  misc_feature: GZ8MTXP01DI9RO.13.55.E11.1.454.CMB.2.raw
  modified_base (221)..(221): a, c, t, g, unknown or other
  misc_feature (221)..(221): n is a, c, g, or t
  modified_base (342)..(342): a, c, t, g, unknown or other
  misc_feature (342)..(342): n is a, c, g, or t
tcagtcacgtactacacgaccggtgctcgatttagcactcgcacgttgggtttggggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcacatcacttgccggnaagtcagagcattaccaactatttgaattggtatcaaacaaaaccaggagagcccctcacctccttatctatggtgcatcctacctactaaagtcggggtcccatacaaggtctacgtggnacgtaggatacgtagggcagtatttacactctcacatcagcagtctgacaacctagaagtattttagactaacttattactggtactaaactagtagtttacagtaccgacggtaaaccgtttccggaccgaaacggggacccgaaagggtaaggtaaacttacgtaaacgaaacgttaggtggcgttcggaccaacgtaactcgttacggtcctttactaacgttccgtttcccccg

SEQ ID NO: 313454 - DNA, 563 bp, Homo sapiens
  misc_feature: GZ8MTXP01D04IW.13.55.E11.1.454.CMB.2.raw
  modified_base (299)..(299): a, c, t, g, unknown or other
  misc_feature (299)..(299): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcacttgatgattatgccatgcacgtggggtccgnaagctaccgagggggaggcctggaggtggtctcgaggttattaggtggaataggtggtagcagtggctagtggcggtactcgtggtaggaagggccgtattcactatctaccagacgacaacgaccaagaacctccctggtactctgacaaatcgaacagacctgagagcgtggaacggacacgggtcctttagtatttagttgttgaacgaaaagtacctaacccctaaaccccttagttagtttttgggaagttttaacggg

SEQ ID NO: 313455 - DNA, 563 bp, Homo sapiens
  misc_feature: GZ8MTXP01DS8DY.13.55.E11.1.454.CMB.2.raw
  modified_base (296)..(296): a, c, t, g, unknown or other
  misc_feature (296)..(296): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcacttgatgattatgcatgcacgtgggtccgnaagctaccgagggaggcctggagtgggtctgaggtattaggttggaataggtggtagcaagtggctaagtggacggtactcgtgtaggacgggccgtatcaccatctaccagacgacaacgccaaacgacctcctaggtactcctagacaaatcgaaacagaccgtagagacgcgtggaacgggacacgggtccttgttaattagttagttcgaacaaaagtactaacccctaaacccgttacgttagtttttgggaagtttaaggg

SEQ ID NO: 313456 - DNA, 546 bp, Homo sapiens
  misc_feature: GZ8MTXP01BRBAX.13.55.E11.1.454.CMB.2.raw
  modified_base (401)..(401): a, c, t, g, unknown or other
  misc_feature (401)..(401): n is a, c, g, or t
  modified_base (436)..(436): a, c, t, g, unknown or other
  misc_feature (436)..(436): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctgggcaggtccctgagactctcctgtgcagcctctggattcacttgatgattatgccatgcacgtggggtccgcaagctccgagggggaggcctgggagtgggtctgaggtattagtggaatggtggtagcatggctatgcggactcgtgtgaagggccattcacatctcaggganacaacgccaagtacctccctggtactctgacaaanagacacgacgngagagcgnggaacggacgacggtcgttgttagttagttagttgaacgaaacgtaacctaaccctaacccgttacgttacgtttaaggttaaggttaagg

SEQ ID NO: 313457 - DNA, 622 bp, Homo sapiens
  misc_feature: GZ8MTXP01CI3Q5.13.55.E11.1.454.CMB.2.raw
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
tcagtcacgtactacacgaccggtgctcgatttagcactcgcacgttgggtttggggagtcagtctcagtcaggacacagcatggacatgagggtccccgctcagctcctggggctcctgctactctggctccgaggtgccaaatgtgacatccagatgacccagtctccatcctcctgtctgcatctgtaggagacagagtcaccatcacttgccgggnaagtcagagcattaccaactatttgaattggtatcaanaaaaccagganagcccncacctccttatctataggtgcatccgacttaccaaagtgggggtccgactcaaggttacagtaggcactggataacctagggtcagagtttctactactcacactcaagcaagtctcgacaaccgtagaagattttacgacaaacttatttaacctgggtttacaaaccgtaagacggttttacaacgttacggacggtaacgttcgggtaccccgaaaggggtacccgaaagggtaaggtaaacggttacaaaaaccgaaaccgtttaacgggggtcggttaaccgttcgacccgtaaccctagttaaccgttcggttaccttacctccgtttaacccgttccccg

SEQ ID NO: 313458 - DNA, 550 bp, Homo sapiens
  misc_feature: GZ8MTXP01BGKS7.13.55.E11.1.454.CMB.2.raw
  modified_base (406)..(406): a, c, t, g, unknown or other
  misc_feature (406)..(406): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagctaattaccaacttatttgaatttggtaatacaaacaaaaaccgagggagacgccccctacaccttccttatctatggtgcatccacttacaaagtgggtacccatcgaggttcagtggcacgtggatcgtgggcagtatttcactctcacatcagcagtctgacaactgaagtntttagactaacttattactggtactaactagtacgtttacagtacggcggtacgttcggaccggaacggaccgaagggtaaggaaacttacgaaacgacgtgtagggcttgacaaccgatctgtccttactcttcccttccccg

SEQ ID NO: 313459 - DNA, 522 bp, Homo sapiens
  misc_feature: GZ8MTXP01CYIKE.13.55.E11.1.454.CMB.2.raw
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
  modified_base (504)..(504): a, c, t, g, unknown or other
  misc_feature (504)..(504): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaaccaattattgaattganacaaacaaaacnggganacgcccctcacctctatctatggtnacactccaacctttaacaaaggtcgggtacccatacgaaggtttcagtggacagtggatacgtgggaacagtatttcactctacaccatcagcagtcngacaactgaatntttanactaattattacgtgtacaaatgtattcagtacgcgacgtcgaccagggacaaggtaacgaaattagaaacagtaggngcngacaactatctntcttactcgttcctcccg

SEQ ID NO: 313460 - DNA, 578 bp, Homo sapiens
  misc_feature: GZ8MTXP01BGF7D.13.55.E11.1.454.CMB.2.raw
  modified_base (223)..(223): a, c, t, g, unknown or other
  misc_feature (223)..(223): n is a, c, g, or t
  modified_base (309)..(309): a, c, t, g, unknown or other
  misc_feature (309)..(309): n is a, c, g, or t
  modified_base (529)..(529): a, c, t, g, unknown or other
  misc_feature (529)..(529): n is a, c, g, or t
  modified_base (555)..(555): a, c, t, g, unknown or other
  misc_feature (555)..(555): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtcctccatcctccctgtctgcatctgtaggagacagatcaccatcacttggccgggnaagtcagagctaattaaccaacttatttagaattaggtaataacaaacaaaaccgagggacgacgcccctacacctctatctatgncatcctacctagaagtcgggtaccatacgaagtcacgtggacacgtggatacgtagggaactagtactttaccacttacctacaacctatcagtactagtctacgactaaaccgtagtaaacgttattttagaacttaactttaattacctagggtactaaacgtagtacgtttacaggtacgacggtacgttcggaccgaaaggaccgaaggaagaaanagaaacgacgtgtgcgttgccaactntctctcttctaacttccgtcccg

SEQ ID NO: 313461 - DNA, 550 bp, Homo sapiens
  misc_feature: GZ8MTXP01D0H1Z.13.55.E11.1.454.CMB.2.raw
  modified_base (220)..(220): a, c, t, g, unknown or other
  misc_feature (220)..(220): n is a, c, g, or t
  modified_base (402)..(402): a, c, t, g, unknown or other
  misc_feature (402)..(402): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcacatcacttgccggnaagtcagagcattaccaactatttgaattggtatcaaacaaaaaccagggagagcccctcacctccttatctatggtgcatccaccttacaaaagtggggtacccatcaaggttcaagtggacacgtggatcgtgggaacagtatttccactctcacatcaagcagtctgcaaactgaagtntttgacaactttattactggtactaacagtactttnacggttacncgggtaacgttcggacccgaaagggtaccaaagggtaaggaaaacttcgaaaacgaacgtgtggcttgaccaacctatctgtcttactaattcccgttccccg

SEQ ID NO: 313462 - DNA, 522 bp, Homo sapiens
  misc_feature: GZ8MTXP01DLIHR.13.55.E11.1.454.CMB.2.raw
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
tcagtcacgtactacacgaccggtgctcgatttagcactcgcacgtttgggtttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcacatctcctgcactggaaatgcagtgatgttgggacttatgaccttgtctcctggtaccgacaacacccaggcaaacgcccccaaatcattattacgggcaataagcggcctnaggctttcngatcgcttctctgctccaagtctggcaaacacgcctcctgacaatctctggactcgagccgaggacgaggctgtattttacngttgtcatatgcaggaagngtgattatgtctttggaagtgggaactaaggttcaccgttcgtggtcacgcccaaggccccaaccctaatcgtcacttcgttccgttccccg

SEQ ID NO: 313463 - DNA, 605 bp, Homo sapiens
  misc_feature: GZ8MTXP01AP6QB.13.55.E11.1.454.CMB.2.raw
  modified_base (224)..(224): a, c, t, g, unknown or other
  misc_feature (224)..(224): n is a, c, g, or t
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
  modified_base (407)..(407): a, c, t, g, unknown or other
  misc_feature (407)..(407): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctggtaggagacagagtcaccatcacttggccgggnaagtcagagctattaccaacttattagaattggtanacaaacaaaaccgaggganacgcccctcacctaccttatctatggtcncaactccctaacttaacgaaaggtcggggtaccctagtactaaggttcagtggctacgtggatcgtagggcagtactttcactctcacatcagcagtcncgacaacgtagaagttatttacgacttaacttattactaggtacaaacgtagtacgtttcaagtacgcgggtaacggttcgaccgaaagggaaccgtaaggtaacggtaaacttacggaaacgttaaacgtgggtacgttcgttcgaccgaaccctagttccgtttcgtaccctttacgtaactttcccggttccccg

SEQ ID NO: 313464 - DNA, 650 bp, Homo sapiens
  misc_feature: GZ8MTXP01DYGUX.13.55.E11.1.454.CMB.2.raw
  modified_base (197)..(197): a, c, t, g, unknown or other
  misc_feature (197)..(197): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagagtcacatcacttgccgggcaagtcagagcattaccaactattagaattggtatacaaacaaaaccgagggagacgcccctcaccttccttatctatggtgacactcctacttaacgaaaggtcgggtaccatacgaaggttcagtggacacgtggatcgtagggaacagtatttacactctacacctatcagctagtctagactaaaccgtagtaagttacttttagaaccttaaactttaatttaaccttaggttaaccctaaagtaacgttacgttttaccgaacggttacggtaccgggtaaccggttccgggtaacccggaaaggggaacccgtaaaggggtaaagtaaacgttaaacgtaaaacggttaaaccgttaggtacggacgttacgacctaaccctattccgttacttccgtttacctaacgtttcccgtttccccg

SEQ ID NO: 313465 - DNA, 592 bp, Homo sapiens
  misc_feature: GZ8MTXP01D6YBS.13.55.E11.1.454.CMB.2.raw
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtcccttcgactctcctgtgcagcctctggaatcactttcagtgacgctggatgaacgtgggtccgccaggctccgagggaagggctggagtggattggccgtaattaaaagtgagcctgatggtaggaccaacagactacgctgcaacccggtgaaacgggcaagacttcgacacgtctaccagagatgaacttacgaaacggaacactaggttcgttactagactaaagtacgaaacgacgccgttacgaccgtcggaccggggacacgtcggtacccgtgttacgttaactggttcgcgagcagcgagttaccgtggcctaacttatttacgtttttacgtcgtttcgtccgggg

SEQ ID NO: 313466 - DNA, 635 bp, Homo sapiens
  misc_feature: GZ8MTXP01BX8K6.13.55.E11.1.454.CMB.2.raw
  modified_base (299)..(299): a, c, t, g, unknown or other
  misc_feature (299)..(299): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggcttatttaaaaggtgtccagtgtgaagtgcagctggtggagtcgtgggggaggcttggtacagcctggcaggtccctgagactctcctgtgcagcctctggattcacttgatgattatgccatgcacgtggggtccgnaacgctaccgagggacggcctggagtgggtctcgaggtattaggtggaaagtaggtggtagacagtgggctagtggcggtactcgtggtaggacggggccgtattacgaccattcctaccgaagacgaaccaactacccgaaacgtaaccttccccgttagggttacttaccgtacgaactaaacgtacggaaacctacggaccctaggtaggaacgtccgtcgggaaggacccgttacgggtcctttaggtatttagtttggttagaactaaaacggtactaaccccgttaaaccccgttacggttacgtttttaagggttaacggtttaacggg

SEQ ID NO: 313467 - DNA, 670 bp, Homo sapiens
  misc_feature: GZ8MTXP01EW4PS.13.55.E11.1.454.CMB.2.raw
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtgcagcctctggattcactttgatgattatgccatcgcacgtcgggtccgacacgccgtacccggaggggaacgggcctggaggtcgggtctacgaggttagttaggtaggaagttaggtggtaagctaagtacggtcttagtcgggacggtaacttcgtggtacggaacggggtccgtacgttaccaacctacttaccgtacccgaaagaaccgaaaccgaaaccggaacccctaaacggggtaaccccttcccgttagttaactccgttacggaactaaacgtacgaacgaacgaccgtaggaacggaagtccgttagggaacggacgtaccggtccgtttaggttatttagttaagtacgaaacgtaaaacggtccttaaccccgtaacccgtttaacgttttaacggg

SEQ ID NO: 313468 - DNA, 562 bp, Homo sapiens
  misc_feature: GZ8MTXP01C3AAF.13.55.E11.1.454.CMB.2.raw
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (286)..(286): a, c, t, g, unknown or other
  misc_feature (286)..(286): n is a, c, g, or t
tcagtcacgtactacacgaccggtgctcgatttagcactcgcacgttgggtttggggggagtcagtctcagtcaggacacagcatggacatgagggtccccgctcagctcctggggctcctgctactctggctccgaggtgccaaatgtgacatccagatgacccagtctccatcctccctgtctgcatctggtagganacagagtcacatcactgccggnaagtcagancattaccatattagatganacaaacaaacngganacgccctcactctatctatggncactccaccttacgaaggtcgggtaccatacgtaggttcagtggacacgtggatcgtagggaactagtattacactctacacatcagcacgtctacgacaacgtagtaattattttacgaacttaacttattacctagtaacaaacgtagttacgttacaggtaccgacggtacgttacggaccgaaagggaaccgtaaagggtaacggaaaattacgaaacgacgttaggcggacttcgactaacattctgttacttctaacgttcgttaacccg

SEQ ID NO: 313469 - DNA, 563 bp, Homo sapiens
  misc_feature: GZ8MTXP01B37IK.13.55.E11.1.454.CMB.2.raw
  modified_base (333)..(333): a, c, t, g, unknown or other
  misc_feature (333)..(333): n is a, c, g, or t
  modified_base (362)..(362): a, c, t, g, unknown or other
  misc_feature (362)..(362): n is a, c, g, or t
tcagtcacgtactacacgaccggtgctcgatttagcactcgcacgttgggtttgggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaacgcccccaaatcattatttacggggtcaataagcggcctcagggctttcngatcgcttcctctggctccagtctgcacncgcctcctgacatctctggactcgaggccgaggacgaggtctgtacttttactgtttagttcattagtggcgaagggaaggtgtgtatttagtgttcgtttagggagtgggaacctaaggttccaccggttccgttggtccgacgccccaacgggtccccaaccccgtaactcggtaccttacctccgttcgttccccccg

SEQ ID NO: 313470 - DNA, 642 bp, Homo sapiens
  misc_feature: GZ8MTXP01D3V72.13.55.E11.1.454.CMB.2.raw
  modified_base (273)..(273): a, c, t, g, unknown or other
  misc_feature (273)..(273): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggtatttttccttttggcttaattttaaaaggtgtccagtgtgaagtgcagctggtggagtcgtgggggagtcgttggtacagcctggcaggtccctgagctctcctgtgcagcctntggattcactttgatgtattatgccatgctacgtcgggtccgacaagtcctaccggaggggacggccgtaggaggtgggtctacgtaggttattaggtggaagttaggtggtaagcgtaagtaggtctagtcggtcgtacttcgtaggtaggaacgggtccgtattaccgaaccgtatcctacgaaggaacgaaccaacgacccaaacggtaacccttcccgtagttaactctacgaactaaacgttacgaaacctacgcgtagaagcgacgttacggacggttacgtaccggttccttaggttactttagttaaggtacgaaacgtaaaacgtaccttaacccgttaaaccccgttaagttttaacgg

SEQ ID NO: 313471 - DNA, 659 bp, Homo sapiens
  misc_feature: GZ8MTXP01DENIR.13.55.E11.1.454.CMB.2.raw
  modified_base (306)..(306): a, c, t, g, unknown or other
  misc_feature (306)..(306): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggcttattttaaaaggtgtccagtgtgaagtgcagctgggtggagtcgtgggggaggcttggtacagcctggcaggtccctgagactctcctgtgcagcctctggattctaccttgatgtattatgccatgcacgtcggggtccgngaacgtccgtacgagggggaacggccgtgggaggttggggtcctcgaggttagtttaggtaggtaagttaggtggtagacaagttaacgggcttaagtcgggacggtacttcgtgggtaggaacggggtcctacgttccaacctagttccctaccgagaacgaaccaaacctaccaaagtaacctcccttaggtaactcgtacgaactaaagtcgaacagacctagaagacgcgtagggaacggtaaccgaccgggtcctttaggtaatttagttacggttagaaacctaaaacggtacttaaccccgttaaaccccgttaggttacgtttttaagggttaacgttttaaggg

SEQ ID NO: 313472 - DNA, 578 bp, Homo sapiens
  misc_feature: GZ8MTXP01DSJUD.13.55.E11.1.454.CMB.2.raw
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccggcaagtcagagcattaccaatattgaattganacaaacaaaacagganacgcccctcacctctatctatggncatccacttanaaagtcgggaccatcgaagttcagtggacacgtggatcgtgggaacagtacttcactcctacacatcagacagtctagactaaaccgtgaaacgtattttgactaaactttaattactagttacaaactagttaacgtttcaaggttaccggacggtacggttccggaaccgaaacgggtaaccgaagggtaaacgggaaacttacggaaaacgttaacgtacggtcggttacgttcgacctaacattccttagtccttactctttcgttaacccg

SEQ ID NO: 313473 - DNA, 604 bp, Homo sapiens
  misc_feature: GZ8MTXP01EPXSS.13.55.E11.1.454.CMB.2.raw
  modified_base (489)..(489): a, c, t, g, unknown or other
  misc_feature (489)..(489): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggctaattttaaaaggtgtccagtgtgaagtgcagctggtggagtcgtgggggagcttgggtacagcctggcaggtcccctgagactctcctgtgcagcctctggattcacttgatgattatgccatgcacgtcggggtccgcaagctcgagggggaggcctggaggtgggtctcgaggttattaggttaggaataggtggtacgacaagtgggctagtggacgggtactcgtggtaggaacgggtccgtattcacctatctaccagacgacaaacgaccaagaactccctaggtactctagacaaagtagaacagacctgagagtcgnggaaggaccgacggtccgtttaggtaactttaagttaggttcgaacgtaaaacgtaccttaacccctaaaccccgtttaccgttaagttttttaacgggttaacgttttaagggg

SEQ ID NO: 313474 - DNA, 572 bp, Homo sapiens
  misc_feature: GZ8MTXP01AQR37.13.55.E11.1.454.CMB.2.raw
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctcctgtctgcatctgtagganacagagtcaccatcacttgccgggcaagtcagancattaccaatattgaattgtanacaaacaaaaccagganacgcccctcacctccttatctatggtncactccaccttagaaacggtcgggtacccatcgaaggttcaggtggcacgtgatcgtgggcagtactttcactctcacatcagcagtctcgacaaccgtagtaaagttattttacgacttaaactttacgtttactacggtaactaaacgtagtacgtttacgacggtacgcggtacgtcgacgaaacgggaccgaaggtaaggaaacttacgaaacgacgtggtacgcgttcgaccaaccgtatcctacgttcttctaacttcccgttaaccccg

SEQ ID NO: 313475 - DNA, 587 bp, Homo sapiens
  misc_feature: GZ8MTXP01DD4EK.13.55.E11.1.454.CMB.2.raw
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccattctccctgtctgcatctgtaggagacagagtcacatcacttgccggnaagtcagancattaccaatattgaattgtanacaaacaaaaccgaggagacgcccctcacctctatctatgtncatccacttacaaagtcgggtccatacaaggttcagtggcacgtggatcgtagggcagtattcactctacacatcagcagtctagacctaaacctgaaacttatttacgacttaactttacttacttaggtaactaaacgtagttacgtttacgaacggttacggaccggtaccggttaccgggaaccgtaaaggggtaacccgaagggtaaggaaaacttaccgaaaacgttacgtaggtcggacttcggacctaacgtacttcgttcgtccttactaacgttcccttccccg

SEQ ID NO: 313476 - DNA, 571 bp, Homo sapiens
  misc_feature: GZ8MTXP01DAMTV.13.55.E11.1.454.CMB.2.raw
  modified_base (256)..(256): a, c, t, g, unknown or other
  misc_feature (256)..(256): n is a, c, g, or t
  modified_base (314)..(314): a, c, t, g, unknown or other
  misc_feature (314)..(314): n is a, c, g, or t
  modified_base (323)..(323): a, c, t, g, unknown or other
  misc_feature (323)..(323): n is a, c, g, or t
  modified_base (352)..(352): a, c, t, g, unknown or other
  misc_feature (352)..(352): n is a, c, g, or t
  modified_base (413)..(413): a, c, t, g, unknown or other
  misc_feature (413)..(413): n is a, c, g, or t
tcagtcacgtactacacgaccggtgctcgatttagcactcgcacgttgggtttggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcacatctcctgcactggaaatgcagtgatggttggacttatgaccttgtctcnggtaccgacaacaccaggcaaacgccccaaatcattattacgggacaataagcgcctnaggctttcngatcgcttctctgctcaagtctgctaacncgacctccctagacaatctctgactcgagccgaggacgaggtctagttactttactggttnttcattagttggacaagggaaggtagtgtatttagtgttacgttaggaaggtgggtaactaaagggttcctaaccggttccgtttagggtacaaccggcccaaacgggccccaaaaccccgttcgttaccgtacttaccgttccgttcccgtaacccc

SEQ ID NO: 313477 - DNA, 598 bp, Homo sapiens
  misc_feature: GZ8MTXP01AVOO5.13.55.E11.1.454.CMB.2.raw
  modified_base (490)..(490): a, c, t, g, unknown or other
  misc_feature (490)..(490): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttcctgctgctatttaaaaggtgtccagtgtgaagtgcagctggtggagtcgtgggggagcttggtacagcctggcaggtccctgagactctctgtgcagcctctggattcacctttgatgattatgccatgcacgtgggtcccgcaaggctccgaagggggacgggccgtgggaggtggggtctcgtaggttattaggttaggaattaggtggtagcgtaaagtagggctagcggcggtactcgtgggtagaacggggcctagttccacctatcctacgaagacgaaccaaccgaccaaacgtaacctccctagtactctagaacctaaagtgaaacncgctaggacgacgcgtaggaacggaacctcgggttcctttaggttactttagtgttacgaacaaacgtctaccctaacccgtttagtgttttaggaagtttggtaacg

SEQ ID NO: 313478 - DNA, 697 bp, Homo sapiens
  misc_feature: GZ8MTXP01EIQGE.13.55.E11.1.454.CMB.2.raw
  modified_base (294)..(294): a, c, t, g, unknown or other
  misc_feature (294)..(294): n is a, c, g, or t
  modified_base (602)..(602): a, c, t, g, unknown or other
  misc_feature (602)..(602): n is a, c, g, or t
  modified_base (660)..(660): a, c, t, g, unknown or other
  misc_feature (660)..(660): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagcgtggtggagtcgtgggggagcttgggtacagccgtggcaggtccctgagactctcctgtgcagcctctggattcactttgatgattangccatgctacgtcgggtccggacaacggccgtaccggaagggggaacgggccgttaggggaggtcgggggtacctacggtagggtttagtttagggttagggtaaagttaagggttgggtaaggcgtaaggtagggtacttaggtcgggacgggtacttcggttaggtacgggaaacgggggtccctaacgttcccaacccgtatacccgtacccgaaaggaaccgaaccgaaacccggaccccgtaaaacgggtaaccccttaccccgttagttaacctacgttacgaaacctaaagtacggaaacncgtaccgtaggagaacgtcgttaggacggacgtacggtcttaggttatttagtggtanaactaaacgcttacccgtaacccgtttaagtttaagg

SEQ ID NO: 313479 - DNA, 848 bp, Homo sapiens
  misc_feature: GZ8MTXP01BDLTA.13.55.E11.1.454.CMB.2.raw
  modified_base (304)..(304): a, c, t, g, unknown or other
  misc_feature (304)..(304): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcttggtacagcctggcaggtccctgagactctcctgtgcagcctctggattcacttgatgattatgccatgctacgtggggtcccganaacggcctaccggagggggaacggcccgtggggtacggtcggggtcctacggtagggttatttacgggttagggtaaagttagggtagggtacgacgtaagttaacgggccttaaggtcgggaccgggtaccgttcgttagggtacgggaaacggggggtcccgtaaacgttttcccgaaaccccgtaatttccccgtaaccccggaaagggtaaaccgaaaaccccggaaaaccccgggtaccccaaaaaacgggtaaaccccgtttcccgggaaccgtttacgggttaaaacttcccgttaaggggaaaaccctaaaaagggttgggggaaaccggtaaaccgggtccccgttaaagggggaaaccgggtaaacccggggcccccgggggaaaaaggggttaaccccggaaaccgggggtacccttttaaggggtttaaaatttaaggtttttaaacggtttgggttagggttaacggtaagggtttaaacgtttaacgggccggttaacctttaaacccgttttaacggttttaacccggg

SEQ ID NO: 313480 - DNA, 527 bp, Homo sapiens
  misc_feature: GZ8MTXP01ENGSE.13.55.E11.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
  modified_base (400)..(400): a, c, t, g, unknown or other
  misc_feature (400)..(400): n is a, c, g, or t
  modified_base (498)..(498): a, c, t, g, unknown or other
  misc_feature (498)..(498): n is a, c, g, or t
  modified_base (509)..(509): a, c, t, g, unknown or other
  misc_feature (509)..(509): n is a, c, g, or t
  modified_base (517)..(517): a, c, t, g, unknown or other
  misc_feature (517)..(517): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagagtcaccatcacttgccgggnaagtcagagcattaccatattgaatgtanacaaacaaaaccgagganacgcccctctacctcttatctatggtncatccacttacaaaggtcgggaccatcaaaggttcagtggacacgtgatacgtgggaacagtatttcactctcactatccagcagtctgactaaactagtaatntttacgactaactttatactggtacaagtagtagttcagtacggcggtacgtcgaccgaagggaccaagggtaagaaattacaaacgagtgtgcgttnacaacatcgtntcttactnttccgtaacc

SEQ ID NO: 313481 - DNA, 585 bp, Homo sapiens
  misc_feature: GZ8MTXP01DN5IN.13.55.E11.1.454.CMB.2.raw
  modified_base (361)..(361): a, c, t, g, unknown or other
  misc_feature (361)..(361): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcttggtacagcctggcaggtccctgagactctcctgtgcagcctctggtattcacttgatgattatgccatcgcacgtcgggtccgacaacgctaccggaggggacggctggaggtggtctgaggtattaggtggaataggtganctagtggctagtggcgactcgtggtagacgggtctatcacgtatcctaccgaagacgaaccaacgaccaacgacctcctaggtactccgtagaacaaatacgaacacgaccgtgaagtcgcgtaggaacgacgttacggtcttaggttaattgttacgttgaaactaaaacgtacccttaacccgttaaacccgttagttagttttcggttaacgtttaacggg

SEQ ID NO: 313482 - DNA, 564 bp, Homo sapiens
  misc_feature: GZ8MTXP01BJIUV.13.55.E11.1.454.CMB.2.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (272)..(272): a, c, t, g, unknown or other
  misc_feature (272)..(272): n is a, c, g, or t
  modified_base (521)..(521): a, c, t, g, unknown or other
  misc_feature (521)..(521): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcacatcacttgccgggnaagtcagancattaccaatattgaattgtaanacaaacaaaaccagggaanacgcccctcacctccttatctatggtcgcactacctaccttaacgaaaggtcggggtacccatacgaaggttcgaggtggacacgtggatcgtgggaacagtatttcactctacaccatcagcagtctagactaaaccgtgaaagttatttacgaccttaaattaattaccttggtactaaactagtagtttcagttacgcggtacgtcgacgaacggtacaagggtaagaaattacgaaacgttacgngtaggcttgacaaccgtatcttgtacttctaacgttctccccg

SEQ ID NO: 313483 - DNA, 575 bp, Homo sapiens
  misc_feature: GZ8MTXP01CMZKD.13.55.E11.1.454.CMB.2.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (297)..(297): a, c, t, g, unknown or other
  misc_feature (297)..(297): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcacatcactgccggnaagtcagancaattaccaattatttgaattggtatacaaacaaaaccagggagacgcccctcaccttctatctatgtncataccacttacgaaacgtgggtacccatcaaggttcacggtgacacgtgactcgtgggaacagtattcactctacaccatcgagctagtctagacctaaccttagtaaacttattttacgacttaaacgtttattaactggtaactaaacgtagtacgtttacacggtaccgtcggtaacgttcggaccgaaaggggaaccaagggtaaggaaattaccgaaacgttaacgtggtgcgttgcctaaccagttcttagtcttactcttccgttccccg

SEQ ID NO: 313484 - DNA, 670 bp, Homo sapiens
  misc_feature: GZ8MTXP01CTACR.13.55.E11.1.454.CMB.2.raw
  modified_base (271)..(271): a, c, t, g, unknown or other
  misc_feature (271)..(271): n is a, c, g, or t
  modified_base (417)..(417): a, c, t, g, unknown or other
  misc_feature (417)..(417): n is a, c, g, or t
  modified_base (632)..(632): a, c, t, g, unknown or other
  misc_feature (632)..(632): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggtatttttccttttggcttattttaaaaggtgtccagtgtgaagtgcagctggtggagtcgtgggggagcttggtacagcctggcaggtccctgagactctcctgtgcagcctntgattcactttgatgtattatgccatcgctacgtcgggtccgacaacgccgtaccggaagggggacggccgtagggaggtcgggtctaccgtagggttagttaggttaggaaagttaagggtagggtaagacgtaaggtacgggtntaaggtcggtacgggtaccttgtagggtacgggaaacggggtcccgtaactttacccgaacccgttacgttacccgtaacccgaagggaaaccgaaacccgtaaaccgaaccccgtaaaacggggtaaccccttcccgttaagtactaccgtacgaacctaaagtacgaacctgaccgtagacgaagcgttaggacggacgtacggtcttagttnttatgacgaactaagccttacctaacccgttgtttaag

SEQ ID NO: 313485 - DNA, 567 bp, Homo sapiens
  misc_feature: GZ8MTXP01ESP3T.13.55.E11.1.454.CMB.2.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
  modified_base (346)..(346): a, c, t, g, unknown or other
  misc_feature (346)..(346): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccggnaagtcagagcattaccaactattgaattggtanacaaacaaaaccaggganacgcccctcacctctatctatgtncatccaccttaacaagtcgggccatacaaggttcagtggcagtggatcgngggcagtactttcactctacaccatcagcagtctagactaacctgtaaatacttttagacttaaacttaatttactagggtaactaaacgtagtaacgtttacgaggttaccggcggtaaccgttcggaccgtaaaggaaccgaaaggtaaggaaacttacgtaaaccgaaagtggtagcgttcgactaaccattctgtcttctaaccttccgtaaccccg

SEQ ID NO: 313486 - DNA, 661 bp, Homo sapiens
  misc_feature: GZ8MTXP01DDBJC.13.55.E11.1.454.CMB.2.raw
  modified_base (229)..(229): a, c, t, g, unknown or other
  misc_feature (229)..(229): n is a, c, g, or t
tcagtcacgtactacacgaccggtgctcgatttagcactcgcacgttgggtttggggggagtcagtctcagtcaggacacagcatggacatgagggtccccgctcagctcctggggctcctgctactctggctccgaggtgccaaatgtgacatccagatgacccagtctccatccctccctgtctgctatcgtaggtaggagacagacgtcacatcacgtcgccgganaagtcagagactacttaaccaacttattagtaattaggtaataacaaacaaaacgagggacacgcccctacaccttcttatctagtgtcactactacctaacttaacgtaaggtccgggtacctagtacgtaggttcgagtcggactagtacggtactacggtaggaactagttacttccacgtcctacactatacgagtacgtagtcacgaaccgtaaccttaggtaatttactttagaaccttaactttaataccgtagttaacctaagtacgtttacttacgtaaccgttcggtaccggtaaccgggtaccgtaacgggtaaacggaaccgtaaagggtaaacgtaaacttaaacggtaaacggacgttagggtcggttaacttcgaacctcgtattcgtacgtccttacgtaaccttccgtaaccccg

SEQ ID NO: 313487 - DNA, 683 bp, Homo sapiens
  misc_feature: GZ8MTXP01BS05B.13.55.E11.1.454.CMB.2.raw
  modified_base (226)..(226): a, c, t, g, unknown or other
  misc_feature (226)..(226): n is a, c, g, or t
  modified_base (371)..(371): a, c, t, g, unknown or other
  misc_feature (371)..(371): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggcttaattttaaaaggtgtccagtgtgaagtgcagcgtggtggagtcgtgggggagcttggtacngcctggcaggtccctgagactctctgtgcagctctgtacttcacttgatgtattatgcctatgcacgtgggtccgacaagccgtacgaggggaggccgtgggagtggtctagtaggttagttaggtaggtaaagttggtaggtanaacgtaagtcgggtctaaagtcgggaccggtacttcgtgggtaacggaacggggtcctattaccgaacctacgtccgtaaccgaaggacgaaaccgaaaccgaaccgaaacgtaccttaccccgtaggttaacttacgtaacgaacttaaaacgacgaaaccgacggtaccgtaggaacgacggtacgtacggaacgggtaaccgttaaccgggttcctttaggttaatttacgttagttacgaaaccgtaaaacgtcccttaaccccgttaacccgtttagtttagttttaacgggttaaggtttaacggg

SEQ ID NO: 313488 - DNA, 639 bp, Homo sapiens
  misc_feature: GZ8MTXP01CFBHS.13.55.E11.1.454.CMB.2.raw
  modified_base (310)..(310): a, c, t, g, unknown or other
  misc_feature (310)..(310): n is a, c, g, or t
  modified_base (493)..(493): a, c, t, g, unknown or other
  misc_feature (493)..(493): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggtattttcctttggcttattttaaaaggtgtccagtgtgaagtgcagctggtggagtcgtgggggagtcttggtacagcctggcaggtccctgagactctcctgtgcagcctctggattcactttgatgattatgtcatgcacgtgggtccgnagctcgagggaggctggagtggtctcgaggtattagtgaatagtgtgctagtaggctagtggcggtactcgtggtaggaacggggtccctattccgacctatcctacccaaggaccgaacaaaccggacccaaacgggtaacccttccccgtagtactacctagaacctaaagtacgaaaccncggtacccgtaggacggaacgtcgttagggaaacgggttaccgtaaaccgggttccttttagggttaacttttacggtttgtaacggtaaactaaaaacggtacccttaaccccccttaaaaccccggtttttaaggttttaaggg

SEQ ID NO: 313489 - DNA, 566 bp, Homo sapiens
  misc_feature: GZ8MTXP01EKX8T.13.55.E11.1.454.CMB.2.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagatcacatcacttggccggnaagtcagagctaattaccaactattgaattggtatacaaacaaaacgaggganacgcccctcacctctatctatgtnacataccacttacaaaggtcgggtaccatacgaaggttcagtgacacgtggatcgtagggaactagtatttacactctacacatcagctagtctagactaacctagtaagttatttacgacttaacttattacgtggtacaaacgtagttagtttacaggtaccggtcggtacggttccggacgaacggaaccgaagggtaacggtaaattacgaaacgacgtgtacgttcgcgacgaactatcgtactcttactaacttccgtccccg

SEQ ID NO: 313490 - DNA, 728 bp, Homo sapiens
  misc_feature: GZ8MTXP01BVENP.13.55.E11.1.454.CMB.2.raw
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagactctcctgtgcagcctcgtggattctacctttgacttgatttagtcgcctatcgcacgtcggggtccgacaaggccgtaccgagggggaacgggccgtaggtaggtgggtctaccgtagggttagttaggttaggaagttaaggtgggttaagcgtagttagggactaagtcggaccgggtacttcgtagggtacggaaagggtccccggtaattaccgaaccctagttcccgaccgaaaggaacgaacccgaaaccggaccctaaacggggtaaacccttcccccggttataacgttaccgtacggtaacctaaaagtaacggaaaccctagggaccccgttaggaacggaacggtacgttacgggaaaccgggttaacgtaaccgggttcgtttaacgttaagtttaagttaacggttacgaaacgtaaaaacggtccttaaaccccgtaaccccgttttaaagggttttaacgg

SEQ ID NO: 313491 - DNA, 731 bp, Homo sapiens
  misc_feature: GZ8MTXP01DD68P.13.55.E11.1.454.CMB.2.raw
  modified_base (283)..(283): a, c, t, g, unknown or other
  misc_feature (283)..(283): n is a, c, g, or t
  modified_base (632)..(632): a, c, t, g, unknown or other
  misc_feature (632)..(632): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggaggcttggtacagcctggcaggtccctgacgactctcctgtgcagcctctggtattcaccttgatgattangccatgctacgtggggtcccgacaacgccgtaccgaagggggaacggtcccgtagggaggttcggggtactacgaggttatttaggttaggaaagttggtggtaagctaagtggactaagtggacggtactcggtaggtacggaacgggtccgtattaccgaccctagttacccgaccgaaggaaccgaaccgaaaccggtaaccccaaaggtaaaccccttccccgttaagggttacttccggtaactaaaccgaaaagttcgaaaccgcggtaacccgtaaggaggtaacgcgttaagggaacgggtaacccgttaccggggtttcctttaaggtttaaacgttttnttaagggttacgaaaaccgttaaaaaaccgtaccttaacccccgtttaaaaccccgtttaggttttaacggtttttaagggaacggtttttaacggggg

SEQ ID NO: 313492 - DNA, 594 bp, Homo sapiens
  misc_feature: GZ8MTXP01EQS5T.13.55.E11.1.454.CMB.2.raw
  modified_base (275)..(275): a, c, t, g, unknown or other
  misc_feature (275)..(275): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (474)..(474): a, c, t, g, unknown or other
  misc_feature (474)..(474): n is a, c, g, or t
  modified_base (534)..(534): a, c, t, g, unknown or other
  misc_feature (534)..(534): n is a, c, g, or t
  modified_base (554)..(554): a, c, t, g, unknown or other
  misc_feature (554)..(554): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggattttccttttggcttattttaaaaggtgtccagtgtgaagtgcagcgtggtggagtcgtggggggagcttggtacagccgtggcaggtccctggagtactctcctgtgcaggcctntggattctactttgatgtattatcgccatcgctacggtcgggtccgacaacggcctacggaagggaacggcctgggagtcggtcacgtaggtattaggtacgtaagtaagtggtgcgtagtagctagtggcgaacttgtagtaggacgggctagtcaacgtntcacgaanacgacaaccgtacaacggtacctccgttnacgtcagaacctaaagagaaacctcgtacagagaacgcgttaggacgttaccgtacgttnttagttattagtaacgtaanaaactaacgtacccttaacccgttaaccgtttaagttaag

SEQ ID NO: 313493 - DNA, 766 bp, Homo sapiens
  misc_feature: GZ8MTXP01A7AKC.13.55.E11.1.454.CMB.2.raw
  modified_base (176)..(176): a, c, t, g, unknown or other
  misc_feature (176)..(176): n is a, c, g, or t
  modified_base (299)..(299): a, c, t, g, unknown or other
  misc_feature (299)..(299): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttcctttggcttattttaaaaggngtccagtgtgaagtgcagctggtggagtcgtgggggagcttggtacagccgtggcaggtccctgagactctcctgtgcagcctctgattcacttgatgatatgccatcgcacgtgggtaccanaacgcctaccggaagggggaacggtccgtgggtagtggggtactacggaggttatttacggtgggaaatcggtggtaacgaacgtagtaacgggtctaagtcggacgggtacttcgtagggtacgggaaacggggtcccgtaacttccgaaccgtacttacccgtaacccgaaggaaaccggaaacccaaacccgggtacccaaaaacggtaacccctttaccccggtaaggggttaaccgtaccttaacggtaaaccaaaacgttacggaaaccgacggtacccgtacggtaaggtaacgcgtaacggggaacggtaacccggttacccggggttaccctttaacgggttaacttttaacggttaggttacggaaaccctaaaaaaccgggttacccttaacccccgttaaaacccccggttttaacggtttacggttttttaaccggggaacggttttaacgggg

SEQ ID NO: 313494 - DNA, 856 bp, Homo sapiens
  misc_feature: GZ8MTXP01EBTAY.13.55.E11.1.454.CMB.2.raw
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggtacttctacttgatgtattatcgcctagtcgcgtacggtcggggtcccgacgaacggtccgtaccggaagggggaacgggtcccgttagggggtacgggttcggggttaccttacggtaagggtttaagttttaacgggttaggggtaaaagtttaggggttaggggtaacggtaaccgtaaggttaacggggtacctttaaagggttccggggtaccgggttaaccgttccgggttaggggttaacgggaaaccgggggtacccgttaactttacccgaaccctacgttacccgttaacccgaaaggaaccgaaacccgaaacccgaccccgtaaaacggtaaccccttaccccgttaaggggttaacttaccggttaacgaaacctaaaagttacgaaaccgtacggtacccgtaaggaacggacggtaccggttaagggaaaccgggtaaccgttaccggggttccgttttaaggttaacgtttagtttacggttaacgttaaaaccgtaaaaacggttacccttaaaccccgtttaaaaccccgtttaggtttaacggttttttaacggggttaacggtttttaaccgggg

SEQ ID NO: 313495 - DNA, 818 bp, Homo sapiens
  misc_feature: GZ8MTXP01AE3F3.13.55.E11.1.454.CMB.2.raw
tcagtcacgtactacacgaccggtgctcgatttagcactcgcacgttgggtttgggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgtggacttatgtaccttgtactccgtacggtacccgacaaccgacccgaaggacccaaaccggacccccctaaaattctaaagttttaacgtttaaccgggggtactaaaggtaaacgcccggtcccctacgtaacgggttccttttcgagtacttcggtcctttcccgttcgtcggtcccttacccgaaacggtttccgtacgggaacccgtaaaccgccccgggtcccttaccccgttaggaacctaaacttcccgttaccgttagggaaccccgttccggaacggggacccggaagggtaacccgggtaagggttccctttaagggtttacttttttaaccgtgggttttacgtttaccaaggtttacgtacgggttacgaaagggggtaaggttaaggttgttaaccgttttaaggtggtttaccggttttaaaggggaacggttcgggtaaacccgtaagggttccctaacccggttccgtttacgggtacccgaacccggttaccccgttaaacgggaaccccccgttaaacccctccgttccgtacccgttacccgttcccgttccccgttcccccg

SEQ ID NO: 313496 - DNA, 617 bp, Homo sapiens
  misc_feature: GZ8MTXP01ERZYV.13.55.E11.1.454.CMB.2.raw
  modified_base (259)..(259): a, c, t, g, unknown or other
  misc_feature (259)..(259): n is a, c, g, or t
  modified_base (323)..(323): a, c, t, g, unknown or other
  misc_feature (323)..(323): n is a, c, g, or t
tcagtcacgtactacacgaccggtgctcgatttagcactcgcacgttgggtttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctctgcactggaaatgcagtgatgttgggacttatgaccttgtctccnggtaccgacaaacccgaccacgacaaccacccaactactattagttacggtacaagtaacgcgnccccgtcgtaggtcgttctcgtaactcgtcttctcgtcgctactacgtcgtacgacgaccgaccgccgtacctacgactactactctcgacgtccgacggaccgacggacggggacggtacgttacgttacgttttacgttcgttacgttacgtagtacgtagtacgtaagggtaagggtaaggtagttagttacgtttaggttacggtttacgggttacgggttacgggttaccggtaacggtaccgttaaccggttccgttacggttaccgtaaccggaacccgtaacccgg

SEQ ID NO: 313497 - DNA, 640 bp, Homo sapiens
  misc_feature: GZ8MTXP01AB9IH.13.55.E11.1.454.CMB.2.raw
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctcgtggtacttcaccttgatgtattatgccatgcacgtcggggtccgcaacgctaccgagggggacggcctgggaggtcggtctacgtaggttattaggtaggaattagggtgtagacgagtcgggctagtcggcgtacttcgtaggtacgggacggggtcctattccaacctactccgtaccgaaggacaaccgaaccgaccaaacggtacccttcccgtaggttactcggttacgaacctaaagtcggaaaccacggtcccgtaggacgacggtccgtagggaacggtaccttacggggttcctttaggttatttagttacgttacggaacaaacgtctaaccccgtaaccgtttagttacgttttgggaacgtttaacggg

SEQ ID NO: 313498 - DNA, 556 bp, Homo sapiens
  misc_feature: GZ8MTXP01E28PC.13.55.E11.1.454.CMB.2.raw
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
  modified_base (359)..(359): a, c, t, g, unknown or other
  misc_feature (359)..(359): n is a, c, g, or t
  modified_base (362)..(363): a, c, t, g, unknown or other
  misc_feature (362)..(363): n is a, c, g, or t
  modified_base (369)..(369): a, c, t, g, unknown or other
  misc_feature (369)..(369): n is a, c, g, or t
  modified_base (526)..(526): a, c, t, g, unknown or other
  misc_feature (526)..(526): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggagcttggtacngacctggcaggtccctgagactctcctgtgcagcctctggattcactttgatgtattatgccatgcacgtggggtccgnaagctacggaggggacggctggagtggtctcgaggtatagtgaatagngtnnataggntagtcggcgtactgtgtaggaacgggtccaattcaaccataccaccgaagaacgaacaaacgacccgaaacggtaaaccctcccgtgtaactctacgacaaaatagaaactagccgagagaacggcttggaacgacgacggtcttagttattatganaacaaagtcttaccctaacccgttgttaag

SEQ ID NO: 313499 - DNA, 570 bp, Homo sapiens
  misc_feature: GZ8MTXP01EPE2U.13.55.E11.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagacgtcaccatcacttgccggnaagtcagncataccatattnatgtanacaaacaaacgaggacacgcccctcacctctatctatgtnacactacctaacctaacgaaaggtcgggtaccagtcgaagttcgagtgacagtgntacgnggcagtattcactctacactatcagctagtctacgactaaacgtagtaacgttatttacgacttaactttattacgtagttacaagtagttacgttacgacgtacggtacgtacggtacgaaccggaacggtaacgtaaggtaaacgaaacgttaacgaaacggttagtaggtacgttcgacgaccaagtactcttctacttctaaccgttcccgtaacccg

SEQ ID NO: 313500 - DNA, 789 bp, Homo sapiens
  misc_feature: GZ8MTXP01C8X1A.13.55.E11.1.454.CMB.2.raw
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcttggtacagctggcaggtccctgagctctcctgtgcagcctctggtacttctaccttgatgtattatgcctagtgcctaacgtcggggtacccgcgaaacgccgtaccggaagggggtaacgggtcccgttaggggacgggttcgggttaccttacggtaaggggtttaagttttaacggggttaggggtaaaagtttagggttacgggggtaagaaccgtaagttaagggtaccgttaaagtcggggtaccggtaacgttacggttgggtaacggggtaaacgggtaccgttacgttacccgtaacctacttacccgtaccgaaacgaacggaaacccgaaccgaacccgaaacgtaaaccccgtttaccccgttaggggttaacttcggttaacgaaacctaaaacgtacgaaaccgtacggaccgtaggtaacggacgtacggtaggaaacggtaccgacgggtttaccttaggttaaactttaagttacggttaagaaaccgtaaaacgtaccttaaccccgttaacccgtttaacggtttagtttttaacggaaggtttttaaccggg

SEQ ID NO: 313501 - DNA, 490 bp, Homo sapiens
  misc_feature: GZ8MTXP01A5M41.13.55.E11.1.454.CMB.2.raw
  modified_base (330)..(330): a, c, t, g, unknown or other
  misc_feature (330)..(330): n is a, c, g, or t
  modified_base (367)..(367): a, c, t, g, unknown or other
  misc_feature (367)..(367): n is a, c, g, or t
  modified_base (458)..(459): a, c, t, g, unknown or other
  misc_feature (458)..(459): n is a, c, g, or t
  modified_base (461)..(490): a, c, t, g, unknown or other
  misc_feature (461)..(490): n is a, c, g, or t
tcagtcacgtactacacgaccggtgctcgatttagcactcgcacgttgggtttgggatacggctcagtctctaatagttactaccccagctggtaccaacagaccccaggccaggctccgcgcacgctcatctacaacacaaacactcgctcttctggggtccctcatcgcttctctggctccatccttagggaaacaaagctgtcccttatcatcgacgggggcccaggcagaagatgaatctagtattattacttgttgttactttatagttggggtatgcctattctgcttgtgttcgggagacggctacccggctcgacccgttcncggtcacggacccgaggcctcgccccgatcccggtcncctcgttccccgtcccctaccctctacgtacgtaacgtacgtcgtaggacgggtcgggcctggggaccgaagggggcccataaagggttcnngnnnnnnnnnnnnnnnnnnnnnnnnnnnnnn

SEQ ID NO: 313502 - DNA, 600 bp, Homo sapiens
  misc_feature: GZ8MTXP01EHOL2.13.55.E11.1.454.CMB.2.raw
  modified_base (341)..(341): a, c, t, g, unknown or other
  misc_feature (341)..(341): n is a, c, g, or t
  modified_base (450)..(450): a, c, t, g, unknown or other
  misc_feature (450)..(450): n is a, c, g, or t
  modified_base (465)..(465): a, c, t, g, unknown or other
  misc_feature (465)..(465): n is a, c, g, or t
  modified_base (476)..(476): a, c, t, g, unknown or other
  misc_feature (476)..(476): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggagcgttgggtaaaggccggggggtcctgagactctcctgtgcagcctctggattcacctttagtagctattggatggagcgtgggtcccgcgaggctccgaggggaggggctgggagtgggtgaccaaanagtaaagcgaaaggttggaagtgaagaaatactatgtggactcgtgtggaagggccgaattccaccatctaccagacgaacaacgaccaaaggaacctcactgtactcngaacaaatcgaaacngcctagaacgngacccggaggtaccacgggtcttgtacttagttcgtggtcgaggaggaggtagggttgggggacgggttaaggttacgtgggacaagggttcggacgttaacgttaacgtttaacgtttaacgg

SEQ ID NO: 313503 - DNA, 835 bp, Homo sapiens
  misc_feature: GZ8MTXP01DR1VO.13.55.E11.1.454.CMB.2.raw
tcagtcacgtactacacgaccggtgctcgatttagcactcgcacgttggggtttgggggggggtcacaagaggcagcgctctcgggacgtctccaccatggcctgggctctgctgctcctcactctcctcactcaggacacagggtcctgggcccagtctgccctgactcagcctgcctcatgtctggtctctggacagtcatcaccatctcctgcataggaaatgcagtgattggttaggtacttagtcgtaccttgtcctccgtacggtaacccgaacaaccgaacccgaggacccaaaacccgaccccctaaaatcgtaagtttaacgtttaaccgggggaacaaagttaaccggccggtaccccttacggacgggttcttttcgaggtaccttcggtcctttcccgtaccgtacggtacccttacccgtaaacggttcccgttacgggaaccctaaaacccggtccccgggtaacccccttaccccgtaaggtaaccccgttaaactttcccgttaccgttaccgggtaaccccttacccgggaacggggtacccgggaaacgggtaaaccgggtacggttaccgtttaaggtttaacctttttaacgtttcgggtttactttaacgtaaggtttaacggttacggacggtaaagggtaaacggtagttagttagtttaaggttcgttagggtttaaggaacggtagggtaaacctaacgggttcctaaaccggtttccgtacggtaccgaacccggacccgttaaacccggtaaccccgtaaaaccctcgttacgtcccgttaccgttccgttcccggtttaaccccccg

SEQ ID NO: 313504 - DNA, 744 bp, Homo sapiens
  misc_feature: GZ8MTXP01AGXJT.13.55.E11.1.454.CMB.2.raw
  modified_base (733)..(733): a, c, t, g, unknown or other
  misc_feature (733)..(733): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccgttttggcttaattttaaaaggtgtccagtgtgaagtgcagcgtggtggagtcgtgggggagtcgttggtacagccgtggcacggtccctgacgctctcctgtcgcacgcctcgtggtcttctacttgatgtattatcgacctagtcgactaccggtcggggtaccgacacggccgtacggaggggacgggccgtaggggtcggtggtcctagtaaggttagtttaggttaggagttaggtaggtaggaactaaggttcgggtctaaaggtcgggtaccgggtaacttcgggtggggtaacgggaacggggtacccgttagttaccccgtaacctacgttacccgtaacccgaaaggaaccgaacccgaaacccggaacccgtaaaccggtaaacccttccccgtaggttaacgtaccgtaacgaacgttaaaacgtaaccgaaacgtaaccggttaccgaggaacgtacggtacggacgggtaacggtaacggttacccgttacgtttaggttacttacgttagttacgaacgtaaacgtcctaaccccgttaaccgttagttacgttttaacggnggtttaaccgg

SEQ ID NO: 313505 - DNA, 883 bp, Homo sapiens
  misc_feature: GZ8MTXP01CHAL2.13.55.E11.1.454.CMB.2.raw
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaggtgtccagtgtgaagtgcagctggtggagtcgtgggggagcttggtacagcctggcaggtccctgagctctctgtgcagcctntggtacttcacttgatgtattancgaccagtgccacgtcggggtccggacaacgcccgtaccggaagggggtaacggggtcccgttagggggacggtttcgggggtccttacggtaacgggtttaagttttacgggtttagggtaaagtttacgggttgggttaacggaaccttaagttaacggggacctttaaggtcgggtaccgggtaaccttcgggttacggggtacgggtaaaccgggggtcccgttaagtttccccgaaacccgttacgttaccccgttaaccccggaaagggaacccggaaacccgaaaaccccgggtaaccccgaaaacggttaacccccgttaccccgttacgggggtttacttacccggttaacgtaaaccctaaaacgtaaccgaaaccgacggtacccggttagggaaacgtccggtaccggtaacgggaaaccgggggtacccgttaacccggggttacccttttacgggtttaaagttttacggtttacggttaaccggaaaccgttaaaaaaccgggttacccctttaaccccccgttttaaaaccccccggtttagggtttttaacggttttttaacggggttaacggggtttttaaccgggg

SEQ ID NO: 313506 - DNA, 749 bp, Homo sapiens
  misc_feature: GZ8MTXP01AXUYI.13.55.E11.1.454.CMB.2.raw
  modified_base (271)..(271): a, c, t, g, unknown or other
  misc_feature (271)..(271): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggtattttcctttggctattttaaaaggtgtccagtgtgaagtgcagctggtggagtcgtgggggaggcttggtacagccgtggcaggtccctgacgactctcctgtgcagcctntggattcactttgatgtattatgccagtcgcacgtcgggtccgacaacgcgtacccgaagggggaacgggtccgtgggtaggtcgggtactaccggtaaggttagttaggtagggtaagttaagggtgggtaagacgtaagttacgggtctaggtcgggacggtaacttcggtagggtacgggaacggggtccgtaatttacccgaaccctagttcccgacccgaagaccgaaaccgaacccgtaaccgaaacggggtaacccctccccgttagtaacgttccaacggaacctaaacgtacgaactacggacccgttaggaaggtaacgtcggttagggaaaccgggttaccgtaaaccggggttcccgttttaggttaaaccgttttcggtttaaagggaccgtaaaacccgttaaaaacgggttaccccttaaaaccccggtttaaacccccgtttttaacggggtttttaaaggg

SEQ ID NO: 313507 - DNA, 842 bp, Homo sapiens
  misc_feature: GZ8MTXP01E1P25.13.55.E11.1.454.CMB.2.raw
tcagtcacgtactacacgaccggtgctcgatttagcactcgcacgttgggtttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactaggaaatagcagtgtagttggttagggacttagtcgtaccttgtcctccgtacggtaacccgaacaaccacccgaggacccaaaacccgcccccctaaaattcgtaaagttttacgtttaaccgggggtacaaacgttaaaccggcccggtaccccctaggtaacgggttcctttcgtacggacttccggtcctttaccccgtcgtacggtccctaccctaaacggttccgttacgggaacctaaacccgcccgggtcccctacccgtagacctaacttccctaccgtacggaccctccggaacgggcccgaaggggtacccgacgggtcttacgttaacgtttttaccgtggtttacgttacctagttactacgggaccgaaaggggaacggttagttagttaacgtttaaggttcggttaccgggttttaaaggggaaacgggtttacccggggaaacccgttaaacggggttaccccttaaccccgggttcccggttacgggttaaacccgaccccgggaacccccgaaaacccggggttccccccaaaacccccgtaacgtttcccggttacccttaacccggtttccccgttaaccccggttttaacccccccccg

SEQ ID NO: 313508 - DNA, 820 bp, Homo sapiens
  misc_feature: GZ8MTXP01CEP10.13.55.E11.1.454.CMB.2.raw
  modified_base (333)..(333): a, c, t, g, unknown or other
  misc_feature (333)..(333): n is a, c, g, or t
  modified_base (428)..(428): a, c, t, g, unknown or other
  misc_feature (428)..(428): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggcttaattttaaaaggtgtccagtgtgaagtgcagctgggtggagtcgtgggggagtcttggtacagcctggcaggtccctgagactctcctgtcgcacgcctcgtggtacttcctacttggattgtaatttacgcgaccctagttcgacgtaacggtccggggtacccganaacggtccgtaccggaagggggacgggtccgtaggggacggtttcggacttacggaagggtttatttaccgggttaggtaaagttaggtaggtanaacgtaaggtcgggtcttaaaggtcgggtaccgtaagttcgggtagggtacgggtaccggggtaccgtacttacccggaaccgtacttacccgttaaccgaacgtaaaccgtaaaccgaaacccggaaaccccaaaacgggttaaccccttaccccgtttaggggttaacttaacccgttagaaaaccgtaaacgaccgtaaaccgacggttacccgtaggtaaccgtaggtcccggaaggaacgggtaacccgttacggtttacccgtttaaggtttaacgtttacgttaagttacgttaaaacgttaaaacccggtacctttaaccccggttaaaccccggttttacggtttaacggtttttaacggggttaaggtttttaacccggggg

SEQ ID NO: 313509 - DNA, 880 bp, Homo sapiens
  misc_feature: GZ8MTXP01BKSWD.13.55.E11.1.454.CMB.2.raw
  modified_base (319)..(319): a, c, t, g, unknown or other
  misc_feature (319)..(319): n is a, c, g, or t
tcagtcacgtactacacgaccggtgctcgatttagcactcgcacgttgggtctgggagaggagccccaaccctgagattcccaggtgtttccattcagtgatcagcactgaacacagaggactcaccatggagttgggactgagctggtatttttcctttggcttaattttaaaggtgtccagtgtgaagtgcagcgtgggtggaggtcggtggggggagtcgttggtacaggcctgggctacggtcccctggacgtacctcgtcctaggtgccgtacgtccctgtcggtacttccgtaccttttggacttgtaatttnacgcctagtcgctacggtacgggtcccgacaacggccgtaccggaaggggggtaccgggtccgttagggggtaaggttccgggggttccgttaaggtaaggggtttaacgtttagggtttaacggggtaaaccgttaggggttaccgggtaagtacccgtaaaagggttacggggtcccttaagggttcggggtaccggtaaccgtttcgggttacggggtaagggaaacccggggtaccttaacttacccaacgtacttacccgtaaaccgtaaaaggggaccaaaccggaaacccttaacggaaaacctacccgttacccggttaatacggggttacccttaaggtaaacccaaaaggttacggaaacccgcggttacccgtaaaggtaaaccgggtacgggtaaccgtacggggaaccggttaaccggttacgggtttacgtttaaggttaacgtttaacgtacggttaaacgaaaccgttaaaccgttaaccccgttaccccgtttaaaccggtttaggtttacgggtttacgggtaacgggtttaacgggtaaccg

SEQ ID NO: 313510 - DNA, 848 bp, Homo sapiens
  misc_feature: GZ8MTXP01C15KY.13.55.E11.1.454.CMB.2.raw
  modified_base (171)..(171): a, c, t, g, unknown or other
  misc_feature (171)..(171): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
tcagtcacgtactacacgaccggtgctcgatttagcactcgcacgttggggtttggggggagtcagtctcagtcaggacacagcatggacatgagggtccccgctcagctcctggggctcctgctactctggctccgaggtgccaaatgtgacatccagatgacccagtcnccactcctccctgtctgcatctggtaggagacagtagtccaaccatcacgttgccgggacaaagtcaagagactacttaaccaattattagaattggtaanacaaacaaaacgnggagaccgccctcactcctatctagtgtcacagtaccctaactaacgtaacggtccgggtacctagtacgtaaggtttccaggtcggacacgtggtactaacgggttagggaacctaggttactttaccgaccttactaacccgacctaagtaccgtaacggtacctagggttaccctacgggttaaaccctaaaccgggtttacgtaaaaggttttaccgttttaacgaaaccgtttaaaacctttttaacgggttaaacctttccggggtaaaacgtaaaaccccggggtttaaaggtttaaccgtttaaccggtaaaacccggggttaccggttaacccgggggtaaacccggtttaccggggtaaaccccggggaaaacgggggtaaaccccggttaaaagggggtaaaccccgggtaaaaaagttaacccggttaaaaaaccgggttacgttaaacgggggttcccgttaaccggcgggttaaccccgtaaccgttaacttcggttttaaccgggttccctttaccccgttaactttcccccccggttttaaccccgg

SEQ ID NO: 313511 - DNA, 561 bp, Homo sapiens
  misc_feature: GZ8MTXP02JUZWE.13.55.E11.1.454.CMB.2.raw
  modified_base (270)..(270): a, c, t, g, unknown or other
  misc_feature (270)..(270): n is a, c, g, or t
tcagtcacgtactacacgaccggtgctcgatttagcactcgcacgttgggtttggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactattgaattggtatcaaacaaaaccagganagcccctcacctccttatctatggtgcatccaccttacaaagtgggtcccatcaaggttcagtggcactggatcgtgggcagatttcactctcacatcagcagtctgcaaactgaaagtatttgactaacttattactagtcaacagtagtttacaagtacgacggacgttcggaccgaaaggggaacccaagggtacgggaaaataccgaaaacgtaaaccgtggttacgggacttacggacaacccgtaaagttccttcggttaccttacgtacttccgtttacccccg

SEQ ID NO: 313512 - DNA, 507 bp, Homo sapiens
  misc_feature: GZ8MTXP02IBBIW.13.55.E11.1.454.CMB.2.raw
  modified_base (307)..(307): a, c, t, g, unknown or other
  misc_feature (307)..(307): n is a, c, g, or t
tcagtcacgtactacacgaccggtgctcgatttagcactcgcacgttgggtttggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactattgaattggtatcaaacaaaaccaggagagcccctcacctccttatctatggtgcatccacttanaaagtgggcccatcaaggttcagtggcactggatcgtgggcagtatttcactctcacatcagcagtctgcaacctgaagtatttgactaaacttattacctgtacaactagtagtttcagtacgcggtacgttcgacgaagggaccaaaggtgaaaatcaaaacgactgtggctgcaaccgatctgtcttcattctcccg

SEQ ID NO: 313513 - DNA, 544 bp, Homo sapiens
  misc_feature: GZ8MTXP02G07PL.13.55.E11.1.454.CMB.2.raw
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactattgaattggtatcaaacaaaaccaggagagcccctcaccctccttatctatggtgcatccaccttacaaagtggggtcccatcaagttcagtgcactgatctgggcagatttcactctcaccatcagcagtctgcaacctgaagtattttcgactaaacttattacctgtactaaacagtaggtttcaagttacgcggtaacgttcggacaagggaccaagggttacgaaaacgtacgaaaacgaactagtacggtactacggacaacctaagtctacgtctttactactcctttaccccg

SEQ ID NO: 313514 - DNA, 508 bp, Homo sapiens
  misc_feature: GZ8MTXP02JRT5H.13.55.E11.1.454.CMB.2.raw
tcagtcacgtactacacgaccggtgctcgatttagcactcgcacgttgggtttgggggagtcagtctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcagtcacgacattaacacttattagcctggtatcagcagaagccaggagagtccctaaattattgatctctgctgcgtccgcttgcaatcggggtccccatctcggtcagtggcggtggatctaggacagaattcactctcaccatcaccaacctgccaccctgagatgttaggaagttattactgtcacgtacctagtagtggtcggcccgtcgtctacgtttcggacggtagggaccgaaggtgacgagactacgaaacgaacgtgtacggctgactaccattcg

SEQ ID NO: 313515 - DNA, 534 bp, Homo sapiens
  misc_feature: GZ8MTXP02JF9H5.13.55.E11.1.454.CMB.2.raw
  modified_base (355)..(355): a, c, t, g, unknown or other
  misc_feature (355)..(355): n is a, c, g, or t
  modified_base (461)..(461): a, c, t, g, unknown or other
  misc_feature (461)..(461): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggagcttggtacagcctggcaggtccctgagactctcctgtgcagcctctggattcacctttgatgattatgccatgcactgggtccgcaagctccgaggggaaggcctggagtgggtctcgaggtattaggttggaatagtggtancatagggctagtgcggtactcgtggtgaagggccgattcgaccatctccagacgacaacaccaagaactccctgtactctagacaaatcgaaacagcctgagagcngaggacgacggccttagtattatagtagacaaaagactacccgtaacccttacgtacttttaggacgtttagg

SEQ ID NO: 313516 - DNA, 532 bp, Homo sapiens
  misc_feature: GZ8MTXP02GR7YY.13.55.E11.1.454.CMB.2.raw
tcagtcacgtactacacgaccggtgctcgatttagcactcgcacgttgggtttggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatacaaacaaaaaccagggagagccccctcacctccttatctatggtgcatccacttacaaagtgggtcccatcaaggttcagtggcacgtggatctgggacagatttcactctcaccatcagcagtctgaccaactgaagtattttgactaaactttattactgtacaacagtagtttacagtaccgcgggtaccgttcggacccaaaggggaccaaaggtaggaaaagtacaaaacgaactgtacggctgacaaccgtatcgtatcttcatcttccg

SEQ ID NO: 313517 - DNA, 537 bp, Homo sapiens
  misc_feature: GZ8MTXP02H6KZG.13.55.E11.1.454.CMB.2.raw
  modified_base (198)..(198): a, c, t, g, unknown or other
  misc_feature (198)..(198): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (314)..(314): a, c, t, g, unknown or other
  misc_feature (314)..(314): n is a, c, g, or t
  modified_base (368)..(368): a, c, t, g, unknown or other
  misc_feature (368)..(368): n is a, c, g, or t
tcagtcacgtactacacgaccggtgctcgatttagcactcgcacgttgggtttgggggagtcagtctcagtcaggacacagcatggacatgagggtcccccgctcagctcctggggctcctgctactctggctccgaggtgccaaatgtgacatccagatgacccagtctccatcctccctgtctgcatctgtagganacagagtcaccatcacttgccgggcaagtcagagcaattaccaactattgaattggatacaaacaaaaccnggaanagcccctcaccctccttatctatggtgcatccaccttaanaaagtgggtccatcaaggttcagtgcactggatcgtgggacagtatttcactcncacatcagcagtctgcaacctgaagtattttgactaaacttatttactagtactaaactagagtttacagtacgcggtacgttcggaccgtaaagggaccgaaaggtacgaaaagtcaaaacgacgtgtacggactgacaacctagtactgtacttcacttcctacccg

SEQ ID NO: 313518 - DNA, 546 bp, Homo sapiens
  misc_feature: GZ8MTXP02IFFN9.13.55.E11.1.454.CMB.2.raw
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
  modified_base (439)..(439): a, c, t, g, unknown or other
  misc_feature (439)..(439): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggagcttggtacagcctggcaggtccctgagactctcctgtgcagcctcnggattcacctttgatgattangccatgcactgggtccgcaagctccgaaggggaaggcctggagtgggtctcgaggtattagtggaatgtggtagcatggctatgcgactcgngtggaaaggccgaattcactanctccagagaacaacgccaaagaactccctagtatctagacctaaanagaacaagacacgagagcgagacggacgacgaccgtacgttacttacgttacgttagtacgaaagaactaacctacccttaaccgttacgtttacgttagtttaagg

SEQ ID NO: 313519 - DNA, 500 bp, Homo sapiens
  misc_feature: GZ8MTXP02I2FJY.13.55.E11.1.454.CMB.2.raw
  modified_base (321)..(321): a, c, t, g, unknown or other
  misc_feature (321)..(321): n is a, c, g, or t
  modified_base (412)..(412): a, c, t, g, unknown or other
  misc_feature (412)..(412): n is a, c, g, or t
  modified_base (482)..(482): a, c, t, g, unknown or other
  misc_feature (482)..(482): n is a, c, g, or t
tcagtcacgtactacacgaccggtgctcgatttagcactcgcacgttgggtttggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaatcattatttacggggtcaataagcgccctnagggctttctgatcgcttcctctggctccaagtctggcaacacggcctcctgacaatctctggactccagccgagacgagctgattttacngttgtcatatgcaggagagtgattatgtcttggaagtggacaggtcacgtctgtcacgccaagccaaccnctcgcactctcgtccccg

SEQ ID NO: 313520 - DNA, 545 bp, Homo sapiens
  misc_feature: GZ8MTXP02JZIXG.13.55.E11.1.454.CMB.2.raw
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaaacaaaaccagggagagcccctcacctccttatctatggtgcatccaccttacaaagtcggggtccatcaaggttcagtggcactggatctgggcagtatttcactctcaccatcagcagtctgcaacctgaaacgtattttgactaaactttattactgtacaacagtagtttcagtacgcggtacgttcggaccgaagggaccaaggtacggaaactacgaaaacggtaactaggtacggactcgaccaaccgtactcgtcgttcttctacttccgtttaccccg

SEQ ID NO: 313521 - DNA, 541 bp, Homo sapiens
  misc_feature: GZ8MTXP02FUKZX.13.55.E11.1.454.CMB.2.raw
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggnaagtcagagcattaccaactatttgaattggtatcaaacaaaaccagggagagcccctcacctccttatctatggtncatccaccttacaaagtgggtccatcaagttcagtgcactggatctgggcagatttcactctcacatcagcagtctgcaactgaagtatttgactaatttattactgtacaacagtagtttacacgtacgacggtacgttcggacgaaagggacccgaaaggtacggaaaattacgaaaacgtaacgtaggttacggactggacaaccgtaactcttacgttcttacacttcctttaccccg

SEQ ID NO: 313522 - DNA, 570 bp, Homo sapiens
  misc_feature: GZ8MTXP02GC6GT.13.55.E11.1.454.CMB.2.raw
tcagtcacgtactacacgaccggtgctcgatttagcactcgcacgttgggtttgggagaggagccccagccttgggattcccaagtgttttcattcagtgatcaggactgagcacagagggctcaccatggagtttgggctgagctggattttccttgctgctatttaaaggtgtccagtgtgaggtgcatctggtggagtcgtgggggaggcttgggtaaaggccggggggtcccttcgactctcctgtgcagcctctggaatcactttcagtgacgcctggatgaacgtgggtcccgccaggcctaccgaaagggaggggctgggagtggattgggaccgtaagttaaaaggtgagccgtgagtgggtagggacaacgagactacgctgccacccgtgaagggcagattcaccatctaccagagatgattacgaaaggaacacgtagttgtttactagactaaatgaaacacgacctacgacgtcgggaccggggacacgtcgtccgtagtacttacgtgtcgccagcacgctagccgtgcctacttatttactttttcgactttcgg

SEQ ID NO: 313523 - DNA, 615 bp, Homo sapiens
  misc_feature: GZ8MTXP02IGCKC.13.55.E11.1.454.CMB.2.raw
  modified_base (309)..(309): a, c, t, g, unknown or other
  misc_feature (309)..(309): n is a, c, g, or t
  modified_base (501)..(501): a, c, t, g, unknown or other
  misc_feature (501)..(501): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggattttcctttggcttaattttaaaggtgtccagtgtgaagtgcagctggtggagtcgtgggggagcttggtacagcctggcaggtccctgagactctcctgtgcagcctctggattcacctttgatgattatgccatgcacgtgggtccgnaagctcgaggggaggccgtgggagtgggtctcgtaggttattaggttggaaagttaggtgggtagctaagtagggcttagtcggacgggtactcgtaggtggaaagggggccctaattccacccgtattccacccgaagacgacaaaccgaccaaagaaccttccctagtactactgaacaaagtgaaaccngaccgtagaacgacgacgtaggaacgaaccgtacggttacctttagttaacgtttagttaacggtaacgtaaacgtaaaacgtaccttaccccgttaaaacccgtttaggttag

SEQ ID NO: 313524 - DNA, 544 bp, Homo sapiens
  misc_feature: GZ8MTXP02FZGJF.13.55.E11.1.454.CMB.2.raw
  modified_base (302)..(302): a, c, t, g, unknown or other
  misc_feature (302)..(302): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccggacaagtcagagcattaccaactatttgaattggtatacaaacaaaaccgaggagacgcccctacacctccttatctatggtncatccacttacaaagtcgggtaccatacaaggttcacgtggcacgtgatcgtgggactagactttcactctacaccatcagcagtctagaccaacctagaagtatttcgactaacttattactagtacaacagtattacaacgtacgcggtacgttcggaccgaagggaccgaaggtacggaaatacaaaacgactaggtcgactgaccaacgtatcgtacgttctactacttccttacccg

SEQ ID NO: 313525 - DNA, 562 bp, Homo sapiens
  misc_feature: GZ8MTXP02HXYPR.13.55.E11.1.454.CMB.2.raw
  modified_base (219)..(219): a, c, t, g, unknown or other
  misc_feature (219)..(219): n is a, c, g, or t
  modified_base (454)..(454): a, c, t, g, unknown or other
  misc_feature (454)..(454): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctcctgtctgcatctgtagagacagagtcaccatcacttgccggnaagtcagagcattaccaactattagaattggtatacaaacaaaaccgagggagacgcccctacacctcttatctatggtgcactcctaaccttaacaaaggttcggggtacccaagtctaaaggttcacggtgacacgtggatcgtggggacagtattcactctacaccatcagcagtctagcaaactgaaagtattttgactaacttattacgtgtacaacgtagtacgtttanagttaccgacggtacgttacggaccgaaggtaccgaaaggttacgaaaactacgaaaacgtacgtagtacggctagacaactagtctacgtcttcgactttctacccg

SEQ ID NO: 313526 - DNA, 558 bp, Homo sapiens
  misc_feature: GZ8MTXP02J09GS.13.55.E11.1.454.CMB.2.raw
  modified_base (374)..(374): a, c, t, g, unknown or other
  misc_feature (374)..(374): n is a, c, g, or t
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatacaaacaaaaaccagggagacgcccctcacctccttatctatggtgcatccaaccttacaaagtgggtcccatcaaggttcagtggcactggatcgtgggcagatttcactctcaccntcagcagtctgcactnaagtatttgactaacttattactntacaaacagtagtttacagttacggacggtacgtttccgggacctaaaggggaacccaaagggttaggaaaactcgaaaacggtaaacctggttacggacttggaccaacccgtaatctcgttaccttctaacttccttccccg

SEQ ID NO: 313527 - DNA, 556 bp, Homo sapiens
  misc_feature: GZ8MTXP02HM3K3.13.55.E11.1.454.CMB.2.raw
  modified_base (197)..(197): a, c, t, g, unknown or other
  misc_feature (197)..(197): n is a, c, g, or t
  modified_base (300)..(300): a, c, t, g, unknown or other
  misc_feature (300)..(300): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagagtcaccatcacttgccgggcaagtcagagcattaccaactattgaattggtatacaaacaaaaaccaggagagcccctcaccttccttatctatggtncatccacttacaaagtgggtcccatcaaggttcagtggcactggactggagagtattactactacctcaccactacagacagtctgcaaccctagtagtatttagtactaacttaatttacttagttacaactaagtagttactacgacgtacggtacgtcggtacgaacggaacgaacgtaaggtaaagactaaacgaaacgtagaggtacgtacgacaccaaccgtatcgttcttactactcctttaccgtccc

SEQ ID NO: 313528 - DNA, 541 bp, Homo sapiens
  misc_feature: GZ8MTXP02FRPA1.13.55.E11.1.454.CMB.2.raw
  modified_base (197)..(197): a, c, t, g, unknown or other
  misc_feature (197)..(197): n is a, c, g, or t
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
  modified_base (540)..(540): a, c, t, g, unknown or other
  misc_feature (540)..(540): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcgggcaagtcagaacattggcaactctttaaattggtatcagcagaagtcagggcaacgccccgaacctcctgatctacggtacatccactttgcacagtggatcccatccaaggttcagtggcagtantctaggaacagtactttacccncaccatcgaggggtctacagcctagaagtatttgcgtactatattgtacaactagtacgtttacccttccgtacccccggtacgttccggaccgaaacggaccgaaggtacggaaagtacgaaacgacgaaactgtacgcgtacgacgaccaatcgtctctctactcctccnc

SEQ ID NO: 313529 - DNA, 557 bp, Homo sapiens
  misc_feature: GZ8MTXP02GVJ67.13.55.E11.1.454.CMB.2.raw
  modified_base (271)..(271): a, c, t, g, unknown or other
  misc_feature (271)..(271): n is a, c, g, or t
  modified_base (437)..(437): a, c, t, g, unknown or other
  misc_feature (437)..(437): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactattgaattgtatacaaacaaaaccagganacgcccctcacctccttatctatgtgcatccactacaaagtcgggtccatcaagttcagtgcactggatcgtgggacagtactttcactcctacacctactcagcagtctgacaaacctgaagtatttgacttaaactttattactagtacaaacagttacgttanacgtaccggcggtacgttcggaccgtaagggaacctaagggtacgaaaactacgaaacgtaaactggtacggactacgacaacgtactccgtcgttactttaccacttcccgttaccccg

SEQ ID NO: 313530 - DNA, 549 bp, Homo sapiens
  misc_feature: GZ8MTXP02FQ47D.13.55.E11.1.454.CMB.2.raw
  modified_base (378)..(378): a, c, t, g, unknown or other
  misc_feature (378)..(378): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttgggtaaagccggggggtcccttcgactctcctgtgcagcctctggaatcactttcagtgacgcctggatgaactgggtccgccaggctccgaggggaaggggctgggagtggattggccgtattaaaagtgagcctgatggtggacaacagactacgctgcncccgtgaagggcagattcaccatctccagagatgattacaaggaacacgagtgttctagacaaatagaacagacctagacgtcggaccggggacacgtcgccgtgtacttacgtgtgcagcacgcagtaccgtggacctacttacttatttttacgacgtttcgtacgggg

SEQ ID NO: 313531 - DNA, 564 bp, Homo sapiens
  misc_feature: GZ8MTXP02JKO3D.13.55.E11.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (376)..(376): a, c, t, g, unknown or other
  misc_feature (376)..(376): n is a, c, g, or t
  modified_base (438)..(438): a, c, t, g, unknown or other
  misc_feature (438)..(438): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagagtcaccatcacttgccggnaagtcagagcattaccaactatttgaattggtatacaaacaaaaccagggagacgcccctcaccctccttatctatggtgcactccaccttacaaagtcgggtaccatcaaggttcagtgcactggatcgtgggcagtattcactctcacatcanctagtctgaccaactgaaagtatttgactaactttatacttgtactaaactagtacgtttanacgtacggcggtacggttacggaccgaaagggaccgaaagggtacggaaaatacgaaaacgtacgtacggtacggacctggacctaaccgacgttactacgttaccttactacttcctttaccccg

SEQ ID NO: 313532 - DNA, 522 bp, Homo sapiens
  misc_feature: GZ8MTXP02FV4HG.13.55.E11.1.454.CMB.2.raw
  modified_base (365)..(365): a, c, t, g, unknown or other
  misc_feature (365)..(365): n is a, c, g, or t
  modified_base (454)..(454): a, c, t, g, unknown or other
  misc_feature (454)..(454): n is a, c, g, or t
  modified_base (501)..(501): a, c, t, g, unknown or other
  misc_feature (501)..(501): n is a, c, g, or t
tcagtcacgtactacacgaccggtgctcgatttagcactcgcacgttgggtttgggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaacgcccccaaatcattatttacggggtcaataagcggccctcagggctttctgatcgcttcctctgctccaagtctggcaacncggcctccctgacaatctctgactccaggccgaggacgaggtctgtattttactgtttgttcatatgactaggaagagtgattatcgtnttaggagtggacaaggtcacgtcttgtcacgccaaggcccaaacccnctcgtacacgtctctaccccc

SEQ ID NO: 313533 - DNA, 545 bp, Homo sapiens
  misc_feature: GZ8MTXP02HOUQV.13.55.E11.1.454.CMB.2.raw
  modified_base (378)..(378): a, c, t, g, unknown or other
  misc_feature (378)..(378): n is a, c, g, or t
  modified_base (468)..(468): a, c, t, g, unknown or other
  misc_feature (468)..(468): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttcgactctcctgtgcagcctctggaatcactttcagtgacgcctagatgaactgggtccgccaggctccgagggaaggggctggagtggattggaccgtattaaaagtgagctgatggtggacaacagactacgctgcncccgtgaagggcagattcaccatctccagagatgattacaaggaacacagtgttactgacaaatgaaacagctagactgccggggacacngccgtagtatactgtagccagccagcagtaccgtcggccacgttattaagtttttcgtaacgtttcgttaccggggg

SEQ ID NO: 313534 - DNA, 649 bp, Homo sapiens
  misc_feature: GZ8MTXP02HJR7U.13.55.E11.1.454.CMB.2.raw
  modified_base (260)..(260): a, c, t, g, unknown or other
  misc_feature (260)..(260): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttggtacagcctggcaggtccctgagactctcctgtncagcctctggattcacctttgatgattatgccatgcacgtgggtaccacaagctaccgaggggacggcctgggagtggtctcgaggtattagtaggattaggtcggtagctagtaggtctagtcggcgtactcgtgtaggagggtccgattccgactactctaccgaagacgaaccgaacggaccaaacggaacccttcccgtaggtaacttccgtacgtaacctaaaatcgaaaacacgaccgtaggaacggtacggccgttagggaaacggtaaccgtacccgggtaaccgttttacggttaaacttttaggttaacggtaacggtaaaacgtaaaaaccggtaccttaacccccgtaaaacccccgtttttaaggttttaaacggg

SEQ ID NO: 313535 - DNA, 562 bp, Homo sapiens
  misc_feature: GZ8MTXP02H9BHY.13.55.E11.1.454.CMB.2.raw
  modified_base (265)..(265): a, c, t, g, unknown or other
  misc_feature (265)..(265): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (396)..(396): a, c, t, g, unknown or other
  misc_feature (396)..(396): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctcctgtctgcatctggtaggagacagagtcaccatcacttgccgggcaagtcagagcataccaatattgatggtatacaaacaaaaccgnggagacgcccctcaccctcttatctatgtncatccactanaaagtgggccatcagtcagtgcactggatcgtgggacagtatttccacttctccacatccagcctagtcctagcctaaaccgtgaaagttntttacgactaactttattacttagtactaacgagtagtttacgaggtacgcggtacgttaccggacgtaaagggaaccgtaagggtaagtaaaacgtcgaaaacgtacgtacggtacggactcggacgaaacctcgttacgtacgtacttcaacgtttccctcccg

SEQ ID NO: 313536 - DNA, 509 bp, Homo sapiens
  misc_feature: GZ8MTXP02JD5YX.13.55.E11.1.454.CMB.2.raw
  modified_base (297)..(297): a, c, t, g, unknown or other
  misc_feature (297)..(297): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactattgaattggtatcaaacaaaaccagggagagcccctcacctcctatctatggtncatccacttacaaagtgggtccatcaagttcagtgcactggatctgggcagatttcactctcaccatcagcagtctgcaactgaagtatttgactaactttattactgtcaacagtagtttcagtacgcggtacgttcggaccaagggaccgaaggtacggaaatacaaacggaaactagtggactgcaaccatctagtctcactcttcccg

SEQ ID NO: 313537 - DNA, 545 bp, Homo sapiens
  misc_feature: GZ8MTXP02IIOQ4.13.55.E11.1.454.CMB.2.raw
  modified_base (274)..(274): a, c, t, g, unknown or other
  misc_feature (274)..(274): n is a, c, g, or t
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
tcagtcacgtactacacgaccggtgctcgatttagcactcgcacgttgggtttgggggagtcagtctcagtcaggacacagcatggacatgagggtcctcgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatacaaacaaaaccgagganacgcccctacacctccttatctatggtnctatccacttacaaagtcgggtcccatcaaggttccagtgcactgatcgngggacagtatttcacttcacaccatcagcagtctgacaactgaaacgtatttcgactaaactttattactgtacaacgtagtatttcgaaggttacgcggtacgttacgcgtaaacgggacaaggtacgaaatacaaaacgtacgtagtacggactacggaaccacgtaactcgtagtccttactacttcccg

SEQ ID NO: 313538 - DNA, 563 bp, Homo sapiens
  misc_feature: GZ8MTXP02J2GSS.13.55.E11.1.454.CMB.2.raw
  modified_base (221)..(221): a, c, t, g, unknown or other
  misc_feature (221)..(221): n is a, c, g, or t
  modified_base (414)..(414): a, c, t, g, unknown or other
  misc_feature (414)..(414): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccggnaagtcagagcattaccaactatttgaattgatcaaacaaaaccaggagagcccctcacctccttatctatggtgcataccaccttacgaaaggtcggggtaccactacaaggttacaacggtggacactagggatacttagggacagtaatttcactctcacactcagcagtctgcaacctgaaagtattttnactaacttagtttactaggtcaaacagtacgtttacgagtacggtaccggacggtttcggacccgaaagggaccgaaggttacggaaatacgaaacgtaaacgttgcggactaggaccaacagtcgtcgttactactactccttccccg

SEQ ID NO: 313539 - DNA, 659 bp, Homo sapiens
  misc_feature: GZ8MTXP02GZVKL.13.55.E11.1.454.CMB.2.raw
  modified_base (487)..(487): a, c, t, g, unknown or other
  misc_feature (487)..(487): n is a, c, g, or t
tcagtcacgtactacacgaccggtgctcgatttagcactcgcacgttgggtctgggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtctggaggaggcttgatccagccgtgggggtccctgagactctcctgtgcagcctcgtgggtccaccgtcagtcacacctacatgagcgtcgggtcccgccgaggcctccggaaggggaacggggtcgtggggaggtcggtccgtttctttactttttaatttagtagttaggtggtagtactatacctccgcacgcgtccggtggacggggccattcaccatccaccaagacgaactaacttaccaaaagaaccacgtcttagtttactaacaaaatcgaaacncgtacctaggaacgacgacccgatacggaaccgaaccgggtccgttagttaacttacgttggacggacggaacggaggtacggtaccgggggacccctaaacgggtaaaaccgttaaccgtaaccggtacgttacggtacggtaaccggttccggtacgggggaaaccccgg

SEQ ID NO: 313540 - DNA, 531 bp, Homo sapiens
  misc_feature: GZ8MTXP02JC617.13.55.E11.1.454.CMB.2.raw
  modified_base (374)..(374): a, c, t, g, unknown or other
  misc_feature (374)..(374): n is a, c, g, or t
  modified_base (499)..(499): a, c, t, g, unknown or other
  misc_feature (499)..(499): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaagccgggggggtcccttcgactctcctgtgcagcctctggaatcactttcagtgacgcctggatgaactgggtccgccaggctccgagggagggctggagtggatggcgtattaaaagtgagcctgatggtggaccacagactacgctgcnccgtgaagggcagattcacatctccagagatgattacaaggaacactagtgttctgacaaatagaacagcctagactcggaccgggtacactgccgtgtattactgtgcagcacgacacgtaccncggctactattatttttcgactttcgtacggg

SEQ ID NO: 313541 - DNA, 609 bp, Homo sapiens
  misc_feature: GZ8MTXP02JDCGH.13.55.E11.1.454.CMB.2.raw
  modified_base (222)..(222): a, c, t, g, unknown or other
  misc_feature (222)..(222): n is a, c, g, or t
  modified_base (311)..(311): a, c, t, g, unknown or other
  misc_feature (311)..(311): n is a, c, g, or t
  modified_base (485)..(485): a, c, t, g, unknown or other
  misc_feature (485)..(485): n is a, c, g, or t
  modified_base (598)..(598): a, c, t, g, unknown or other
  misc_feature (598)..(598): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgganaagtcagagcaattaccaacttatttgaattggtatacaaaacaaaaccgagggaacgacgcccctacacccttccttatctagtggtncactccaccttacgaaaggtcgggtacccagtacaaggttcaggtcgacacgtggatcgtagggacagtactttcacctctcaaccatacagcctagtctcgacctaaaccgtgtaagttattttacgacttaaacgtttaattacgttacgtaacaacgtaggttacgtttanacgggtaccgtacgggttacggttaccggaccggaaacggggaaccgtaagggtaacgaaaacttacgaaaaccgtacgtagtcgactcgaccaacgtatcttacgctttacncttcctacccg

SEQ ID NO: 313542 - DNA, 540 bp, Homo sapiens
  misc_feature: GZ8MTXP02FRE1S.13.55.E11.1.454.CMB.2.raw
  modified_base (230)..(230): a, c, t, g, unknown or other
  misc_feature (230)..(230): n is a, c, g, or t
  modified_base (295)..(295): a, c, t, g, unknown or other
  misc_feature (295)..(295): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccggcaagtcagancattaccaactattgaattggtatacaaacaaaacaggagacgcccctcacctcttatctatgtncatccactacaaagtcgggtaccatcaagttcagtgcactgatcgtgggcagatttcactctacacatcagcagtctgacaacctgtaaagtattttgactaactttattactgtacaactagtagtttacaacgtacgacggtacgttacggaccgaaagggaccgaaagggtagaaaactacgaaaacgacgtaggtacggactagaccaacgtactactcgttcttactacttccttacccg

SEQ ID NO: 313543 - DNA, 562 bp, Homo sapiens
  misc_feature: GZ8MTXP02J3TXN.13.55.E11.1.454.CMB.2.raw
  modified_base (381)..(381): a, c, t, g, unknown or other
  misc_feature (381)..(381): n is a, c, g, or t
tcagtcacgtactacacgaccggtgctcgatttagcactcgcacgttgggtttgggagaggagccccagccttgggattcccaagtgttttcattcagtgatcaggactgaacacagagggctcacccatggagtttgggctgagctggattttccttgctgctattttaaaaggtgtccagtgtgaggtgcatctggtggagtctgggggaggcttgggtaaagccggggggtcccttcgactctcctgtgcagcctctggaatcacttttcagtgacgcctggatggaactgggtccgccaggctccgaggggaggggctggagtggattggaccgtatttaaaagtgagcctgatgggtggaccacagctacgctgcncccgtgaagggcagattcaccatctccagagatgattacaaaggaacacagttgtttctagacaaatgaacagacctgaccgtcggccgggggtacacgtgccgtgtatttactgtcgccagcacgcacgtaccgtcggcctactttactttattttttacgtactttcggttaccggggg

SEQ ID NO: 313544 - DNA, 495 bp, Homo sapiens
  misc_feature: GZ8MTXP02I8KZ6.13.55.E11.1.454.CMB.2.raw
  modified_base (197)..(197): a, c, t, g, unknown or other
  misc_feature (197)..(197): n is a, c, g, or t
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (448)..(448): a, c, t, g, unknown or other
  misc_feature (448)..(448): n is a, c, g, or t
  modified_base (469)..(469): a, c, t, g, unknown or other
  misc_feature (469)..(469): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagagtcaccatcacttgccgggacaagtcagagcattaccaattattgaattgatacaaacaaaacagganacgccctcacctcttatctatgncatccactanaaagtggtccatcaagtcagtgcacngatcgnggacngtattcactctcacatcagcagtctgacaactgaagtacttgactaattatactntacaanagtattanagtcgacgtacgtcgacgtaacgacgaaggtacgaaaanacgaaaagtacgtgacgacanacaactatctctactctactcctccg

SEQ ID NO: 313545 - DNA, 665 bp, Homo sapiens
  misc_feature: GZ8MTXP02JD52K.13.55.E11.1.454.CMB.2.raw
  modified_base (223)..(223): a, c, t, g, unknown or other
  misc_feature (223)..(223): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccggganaagtcagagctattaccaacttattgaattggtatacaaacaaaaccgaggacgacgcccctactacctccttatctagtggtgcactacctaccttaacgaaaggtcggggtcccctaatacgtaaaggttcaggtggcacgtggatcgtgggacagtacttcactctcaccatcagcagtctacggacctaacctaggtaaacttagttttacgaccttaaacttttaactttaacgtacgtttaacccaaagtaacggtttacgttttaccgaacggttaaccgggtccgggttaaaccgggtttccgggaccggtaaacggggaacccgtaaaaggggtaacggtaaaactacgtaaaaccggtaaacgttcgggtacggacctcggactaacctacgttacccttggttacccttactacgtttcccgtttaccccg

SEQ ID NO: 313546 - DNA, 591 bp, Homo sapiens
  misc_feature: GZ8MTXP02JQ820.13.55.E11.1.454.CMB.2.raw
  modified_base (377)..(377): a, c, t, g, unknown or other
  misc_feature (377)..(377): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttggtaaaggccggggggtcccttcgactctcctgtgcagcctctggaatcactttcagtgacgctggatgaacgtggtccgccaggctccgagggagggctggagtggatggccgtaattaaaagtgagcctgagtggtggaccacgagactacgctgcncccgtgaaggcagatcaccatctccagagatgatacaaggaacaacgtagttgtttactagactaaagtagaaacagaccgtagaccgtacggaccggggacacgtcggtaccgtagtacgtttaccgtgtcgaccgacggccgacgaccgtaacgtaccgtcggacctaaccgtttactttacgttttttacgtaccgtttcggtaccggggg

SEQ ID NO: 313547 - DNA, 619 bp, Homo sapiens
  misc_feature: GZ8MTXP02ID2OQ.13.55.E11.1.454.CMB.2.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctcctgtctgcatctgtagganacagagtcaccatcacttgccggtcaagtcagagctaattaccaacttatttgaattggtatacaaaacaaaaccgaggacgacgcccctacaccttccttatctatggtnacactcctaaccttaacgaaaggttcgggtaccctaataccgtaaggttcaggtcggacctacgtggtatccggtagggactagttatttccacttcctaccacactccagccagtctacggactaaccgtgtaaagttattttcgacctaatttagttacttacgtaactaacagttacgtttacgaacggttacggtacggtacggttaccgggacgaaacgggtaccgaaaaggttacggaaaactacgaaacgtaaacgtcgtacgcgtagaccaaccgtatcgttactcctttacacttccctcccg

SEQ ID NO: 313548 - DNA, 611 bp, Homo sapiens
  misc_feature: GZ8MTXP02HWLMR.13.55.E11.1.454.CMB.2.raw
  modified_base (374)..(374): a, c, t, g, unknown or other
  misc_feature (374)..(374): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtggggtcccgacaagcctccgaggggaacggcctgggagttgggtctcgaggttatttagttaggaagttaggtgggttacgngtaagtgggcttagtggccggtatcgtggtaggaacggggccgattcgaccatcctaccagacgaacaaccgaccaaacgaaccttccctagttacttcgtagacaaactgaaaccgagccgtagagagtcgtaggaacggactaccgggtcctttaggtactttacgttagacgtaacgaaaaagtccttaacccgtaaaccccttagtttacgtttttagggacgttttaacggg

SEQ ID NO: 313549 - DNA, 597 bp, Homo sapiens
  misc_feature: GZ8MTXP02HTGO8.13.55.E11.1.454.CMB.2.raw
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctcctgtctgcatctgtaggagacagagtcaccatcacttggccgggacaagtcagagactattaaccaactatttagaattggtatacaaacaaaaccgaggagacgcccctcacctccttatctatggtgacactcctaaccttaacgaaaggtcggggtaccagtacgtaaggttcaggtcgcacgtggatcgtgggactagtacttcacttctaccaacctactacagctagtctagacctaacgtagtaactatttcgacttaaacttatttactagtactaaactagtacgtttacacgtacgacggtacgttcgggacgaacgggaacgtaacggtagaaaagtaccgaaaacgtacgtagtacgtcgtacgaccgaacctacgtactcgttccttacgtacttcccgttaccccg

SEQ ID NO: 313550 - DNA, 592 bp, Homo sapiens
  misc_feature: GZ8MTXP02J1N2J.13.55.E11.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
  modified_base (359)..(359): a, c, t, g, unknown or other
  misc_feature (359)..(359): n is a, c, g, or t
  modified_base (391)..(391): a, c, t, g, unknown or other
  misc_feature (391)..(391): n is a, c, g, or t
  modified_base (411)..(411): a, c, t, g, unknown or other
  misc_feature (411)..(411): n is a, c, g, or t
  modified_base (521)..(521): a, c, t, g, unknown or other
  misc_feature (521)..(521): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatcgacccagtcctccatccctccctgtctgcatctgtagganacagatcaccatcacgttggccgganaagtcagancaattaaccaacttatttgaattggtaatacaaaacaaaaaccgagggaanacgcccctacacctccttatctatggtncatccaacctagaaagtcggtccatcagtcagtgcacgtgatcgnggacagtacttcatctactacatcagcacgtntcgactaacgtgtaaagttntttacgacttaaatttacttaatgtaccaaattagtaacgtttacgacggtacggtaccggtaacggttccggaaccggaaaaggggaacctaaaggggtacggtaaaanaccgtaaaacgaacgttcggagcccgtagaccaactaacgttcgtacgttacttacctaccttccgtaccc

SEQ ID NO: 313551 - DNA, 772 bp, Homo sapiens
  misc_feature: GZ8MTXP02F10P5.13.55.E11.1.454.CMB.2.raw
tcagtcacgtactacacgaccggtgctcgatttagcactcgcacgttgggtttgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcttggtacagccgtggcacggtccctgacgtactctcctgtgcacgcctcgtggtacttcctaccgtttgattgtatttagtcgacctagtcgaccgtacggtcgggtccggacaaacggccgtaccggaaggggtacgggtccgtgggtacggttcggggttactacggtaaggtttaagtttaagggttagggtaaagttaggttagggtaacgtacgtaaggtacggtcgtagtcgggtaccggtacttcggtagggtaagggaacgggtaccgtacgttaccaaccgtactaccgtacgaaacggaacgaaaccgaaaccgaacccgaaaaccgtaacccgttacccgttacgttaaccttacgtaacgaaactaaaacgtacgaaaccgtacggtaccgtaggaaacggtagacgtaacggaacggaccgtaccggttacgtttagttaaatttacgtagtaacgtaaaaccgtaaaacgtaacccgtaaaccccgttaaacccgtttaacggtttacggttttaacggtacggtttacggtttaaaccggg

SEQ ID NO: 313552 - DNA, 564 bp, Homo sapiens
  misc_feature: GZ8MTXP02JUVU1.13.55.E11.1.454.CMB.2.raw
  modified_base (314)..(314): a, c, t, g, unknown or other
  misc_feature (314)..(314): n is a, c, g, or t
  modified_base (370)..(370): a, c, t, g, unknown or other
  misc_feature (370)..(370): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcggcaagtcagaacattggctaactctttaaatggtatcagcagaagtcagggcaacgcccccgaactcctgactctacgtacatcctactttgctanagtggactcccatccaggttcagtgcagtagatcgtaggaactagtactttacccncaccctagtcgtagggtctaacagctagaagttactttgacgtacttatattagtacaactagtacgtttaccctccgtacccccggacgttccggaccgaacgggaccgaaggggtacgaaatacgaagccgtaaacgtggcggcctaggccaaccgtaagtacttcgtccttactacgttccctcccgtacc

SEQ ID NO: 313553 - DNA, 718 bp, Homo sapiens
  misc_feature: GZ8MTXP02JVPQR.13.55.E11.1.454.CMB.2.raw
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
tcagtcacgtactacacgaccggtgctcgatttagcactcgcacgttgggtttgggggggtcacaagaggcagcgctctcgggacgtctccaccatggcctgggctctgctgctcctcactctcctcactcaggacacagggtcctgggcccagtctgccctgactcagcctgcctcatgtctgggtctcctggacagtcgatcaccatctcctgcactggaaatgcagtgatgtggacttatgaccttgctcctggtaccgacacaccaggcaacgccccaaatcattattacgggtcaatagcgtcctnaggtcttcngtactcgtacttcctcgtggtctaccgaagttcctggcctaacgacgggtcccttacccgtagtaacctaaacttccgtacgttacggtaacccgttcccgaacggggtcccggtaaaggggtaccgtaaacgggtccgtttacggttaacgttttttaacgtcggtttacgttacgtaacgtttacgttcggtaccgtaaggggtaaacggtgttaccggttaagtttacgttcggttacgtttacgggaaacggttacgggtaacccgttaagggttacccgtaaacccggtttcgtttacggtacccgtaacggtacccccgtaaaggggtaacccctaaaccccggttacgttaccggtaccctaaccgttcccgtaccggttttaccccccgg

SEQ ID NO: 313554 - DNA, 520 bp, Homo sapiens
  misc_feature: GZ8MTXP02FS8GA.13.55.E11.1.454.CMB.2.raw
  modified_base (394)..(394): a, c, t, g, unknown or other
  misc_feature (394)..(394): n is a, c, g, or t
  modified_base (498)..(498): a, c, t, g, unknown or other
  misc_feature (498)..(498): n is a, c, g, or t
tcagtcacgtactacacgaccggtgctcgatttagcactcgcacgttgggtttgggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaacgcccccaaactcattattacgggtcaataagcgccctcaggctttctgatcgcttcctctgctcagtctggcacacgcctcctgacatctctgactcgaggccgagacgngctagtatttactgtttgtcatatgcaagggagagtgtattagtagttcttagggaagtggacctaggtccacgttcgttagtcgacgtccgaacgccaacccnctcgactactctcgttcccccg

SEQ ID NO: 313555 - DNA, 590 bp, Homo sapiens
  misc_feature: GZ8MTXP02HJS3J.13.55.E11.1.454.CMB.2.raw
  modified_base (259)..(259): a, c, t, g, unknown or other
  misc_feature (259)..(259): n is a, c, g, or t
  modified_base (385)..(385): a, c, t, g, unknown or other
  misc_feature (385)..(385): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttgggtacagcctggcaggtccctgagactctcctgtgcagcctntggattcactttgatgattatgccatgcacgtcggggtccgacaacgctccggaggggacggccgtggaggtcgggtctagaggttattaggtaggaatggtggtagcagtggctagtgcgatcgngtgaacgggctagtcacatcacagacgacaacgacaagtacctcctagtactcagacaaatcgaacagccgtagacgacgtcgacggaacggaccgtaccggtaccgtttagtaacgtttagtcggttaacgaaaccgtaaaacgtacccttaaccccgtaaaccccgttttaggttagtttttacggggaagttttaaccgggg

SEQ ID NO: 313556 - DNA, 617 bp, Homo sapiens
  misc_feature: GZ8MTXP02JHBIB.13.55.E11.1.454.CMB.2.raw
  modified_base (268)..(268): a, c, t, g, unknown or other
  misc_feature (268)..(268): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagctctcctgtgcagcctcnggattcacctttgatgattangccatgcacgtgggtccgnaagctccgaggggacggcctggagtgggtctcgtaggtattaggtggaataggtgggtagctaagtaggctagtggacggacttcgtggtacggaaacggggtcctaactttaccgaccctaagttcccgtacccgaaagaaccggaaccaaaacccggcccaaaaggtaaccccttccccgtagttacttaccgtagaacctaaaagtcgaaactagcccgtagagacgtcgtaggaacggtacacggtccttagttatttagtcgtagaaactaaaagtaccttaccctaaacccgtttagtttagg

SEQ ID NO: 313557 - DNA, 616 bp, Homo sapiens
  misc_feature: GZ8MTXP02I2ST3.13.55.E11.1.454.CMB.2.raw
  modified_base (222)..(222): a, c, t, g, unknown or other
  misc_feature (222)..(222): n is a, c, g, or t
  modified_base (296)..(296): a, c, t, g, unknown or other
  misc_feature (296)..(296): n is a, c, g, or t
  modified_base (394)..(394): a, c, t, g, unknown or other
  misc_feature (394)..(394): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggnaagtcagagcattaccaatatttgaattgtatacaaacaaaaccgaggagacgcccctcacctctatctatgtncatccactacaaagtcgggccatcagtcagtgcatggatcgtgggcagtacttcactctacaccatcagctacgtctagacctaaccgtgtaaagttnttttacgaccttaaactttacttaacttagtaactaaacgtaggttacgttttacgacggttacggtacgggtaccggtttacggaaccgtaaaggggtaacccgaaagggttaacggtaaaacgtaaccgtaaaaaccggtaaacgttaggtaccgggacttacggaaccgtaacctacgttccgttacgttaccttacctacctttccccgtttaccccg

SEQ ID NO: 313558 - DNA, 565 bp, Homo sapiens
  misc_feature: GZ8MTXP02H2OE8.13.55.E11.1.454.CMB.2.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctcctgtctgcatctgtagganacagagtcaccatcacttgccgggnaagtcagagcattaccaactattgaattggtatacaaacaaaaccgaggganacgcccctacacctccttatctatggtncatccaccttaacgaaaggttcgggtacccatacgaaggttcagtggacagtgatcgtagggctagtatttccactctcacatcagcagtctgcaactgaatatttacgactaacttattactgtacaactagtacgtttcaagttacgacggtacgttcgacccgaagggacctaaagggttagaaaacttacgaaaacgtacgtaggtacggtacctgactaaccacgttcctacgtcctttactactttacccgttccccg

SEQ ID NO: 313559 - DNA, 568 bp, Homo sapiens
  misc_feature: GZ8MTXP02G2E9S.13.55.E11.1.454.CMB.2.raw
  modified_base (259)..(259): a, c, t, g, unknown or other
  misc_feature (259)..(259): n is a, c, g, or t
  modified_base (406)..(406): a, c, t, g, unknown or other
  misc_feature (406)..(406): n is a, c, g, or t
  modified_base (522)..(522): a, c, t, g, unknown or other
  misc_feature (522)..(522): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttgggtacagcctggcaggtccctgagactctcctgtgcagcctntggattcacctttgatgattatgccatgcacgtggtccggcaagctccgagggaggcctgggagtgggtctagaggtattaggtggaatggtgtacgcattagggctagtgcggtatcgtagtggaacgggccgtattccaccatcncccgaagacgaacaaacgaccaaagtaacctaccctagtaactcgttagaccaaatacgaaacaagcctagaacgagcaggacgacacggtcttagtattattagacgaacaaaanctaaccctaaacccgttagtacgttttaggacgtttagttaaaccg

SEQ ID NO: 313560 - DNA, 669 bp, Homo sapiens
  misc_feature: GZ8MTXP02H0FID.13.55.E11.1.454.CMB.2.raw
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggcttaattttaaaggtgtccagtgtgaagtgcagctggtggagtcgtgggggaggcttggtacagtccgtggctaggtccctggagacctctcctgtcgcacgtcctcgtggtacttctacctttgatgtattangccatgcgacgtggggtccganaacgcgtaccggaggggacggcgtagggaggtggtacctgtaggtattaggtagtaagtaggtggtagctagtgtctagtgcggtacttcgtagggtacggacgggtaccgtattccacctagtaccctacgaagaacgaaccgaaaccgaccaaaacgtacccttaccccgtattacgttactacgaacctaaaagtacggaaaccaacgggtcctaggaagacgtacgagggtaaccggacggttaccggtaccgtttagttaacgtttagtacggttaagaaacgtaaaacgtaccttaacccccgttaaacccgtttaagtttacggtttaggttaacggtttacgg

SEQ ID NO: 313561 - DNA, 492 bp, Homo sapiens
  misc_feature: GZ8MTXP02GVVU9.13.55.E11.1.454.CMB.2.raw
  modified_base (269)..(269): a, c, t, g, unknown or other
  misc_feature (269)..(269): n is a, c, g, or t
  modified_base (425)..(425): a, c, t, g, unknown or other
  misc_feature (425)..(425): n is a, c, g, or t
  modified_base (473)..(473): a, c, t, g, unknown or other
  misc_feature (473)..(473): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactattgaattggtatcaacaaaacagganagcccctcacctcctatctatgtgcatccactacaaagtgggtccatcaagttcagtggcactggatcgtgggcagtatttcactctcacatcagcagtctgcaacctgtaagtatttgactagttacttaattacttagtcagcagtatagttanggaataccgtcggactaagggacacgatggaagataaaagactgtagngtgacacatcgtgtcttac

SEQ ID NO: 313562 - DNA, 654 bp, Homo sapiens
  misc_feature: GZ8MTXP02JXTKS.13.55.E11.1.454.CMB.2.raw
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (550)..(550): a, c, t, g, unknown or other
  misc_feature (550)..(550): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggaggcgttggtacagcctggcaggtccctgagactctctgngcngcctntggattcactttgatgattatcgcctatcgctacggtcggggtccgacaacggccgtacccgggaaggggacgggtccgtaggggagggtcggggttctaccggtaaggttagtttagggttaggaagttacgggttagggtacgcgtaagtaaggggtcttaagtcgggacggtacttcgtggtaacggacggggcctattccgacctatccgtacgaagacgaaccaaacccggaccaaagtaccttcccgtagtactcgtaacgacaaatcgaacncgaccgtagacgacggactagggacgaccgacggttacttagtaatttagtaacgtaacgaactaaaacgtaccttaacccccgttaaaccgtttagtttacgg

SEQ ID NO: 313563 - DNA, 571 bp, Homo sapiens
  misc_feature: GZ8MTXP02H1DBV.13.55.E11.1.454.CMB.2.raw
  modified_base (223)..(223): a, c, t, g, unknown or other
  misc_feature (223)..(223): n is a, c, g, or t
  modified_base (303)..(303): a, c, t, g, unknown or other
  misc_feature (303)..(303): n is a, c, g, or t
  modified_base (371)..(371): a, c, t, g, unknown or other
  misc_feature (371)..(371): n is a, c, g, or t
  modified_base (557)..(557): a, c, t, g, unknown or other
  misc_feature (557)..(557): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtccaccatcacttgccgggnaagtcagacgcaattaccaacttatttgaattggtatacaaacaaaaccgagggacacgccctcaccctcttatctatgncatccactacgaagtcggccatcaagtcagtcgcacgtggatcgtgggcagtattcactctacacctntcagcagtctcgacctaacgtgtaaagttctttacgactaactttaacgttactgtacaactagtagtttacgaagtaccggacggtacgttccggaccgaaacgggaccgtaaacgggtaaggtaaactaaacgaaaacggtaaccgtaggtacgacgtcgactaaccagttctcgttacttacnctttacccgtcccg

SEQ ID NO: 313564 - DNA, 629 bp, Homo sapiens
  misc_feature: GZ8MTXP02F1K4G.13.55.E11.1.454.CMB.2.raw
tcagtcacgtactacacgaccggtgctcgatttagcactcgcacgttgggtttgggagaggagccccagccttgggatttccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttcgactctcctgtgcagcctctggaatcactttcagtgacgcctggatgaactgggtccgccaggctccgagggaagggcgtggagtggattggccgtattaaaagtgagcctgatggtggacaacagactacgctgcacccgtgaagggcagattcaccatctccagagatgattacgaaggaacactagtgtttctaggacaaatgaaacgacgaccgttagaaccgtcgggaccggggtaccgaacgtcggacccgtttagtaacgtttacgtacggttcggaccgaacggccgacggacccgtacggttaaccccgtcggggtacccttaacgttttaacgttttacggtttttttacgtacccgtttacggtttaacccgggggg

SEQ ID NO: 313565 - DNA, 691 bp, Homo sapiens
  misc_feature: GZ8MTXP02HWSPK.13.55.E11.1.454.CMB.2.raw
  modified_base (294)..(294): a, c, t, g, unknown or other
  misc_feature (294)..(294): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggtatttttccttttggcttaattttaaaaggtgtccagtgtgaagtgcagctggtggagtcgtgggggagtcttggtacagcctggcaggtccctgagactctcctgtgcagcctctggattcactttgatgattangccatgcacgtgggtccgcaagctaccgaggggacggcgtggagtgggtctcgaggttattagtaggataggtggtagcaagtaggcttaagtcggacggtactcgtaggtaggaacggggtcccgtaatttcccaaccctaactttccgacccgaaggacgaaaccaaacccgggaccctaaaacggtaacccttaccccgtaggttaactccgttagaaacctaaaagttacggaaacaacggcctaagggaaacgacggtaccgtaggggaaacggtacccgtaaccggggttacccttttaaggttaagtttaacgtttaagggaacgtaaaaccgtaaaaacggttaccctttaaaacccccgtaaaaccccgtttttaaggttttaacggg

SEQ ID NO: 313566 - DNA, 785 bp, Homo sapiens
  misc_feature: GZ8MTXP02JF5QN.13.55.E11.1.454.CMB.2.raw
  modified_base (283)..(283): a, c, t, g, unknown or other
  misc_feature (283)..(283): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctgtggtacttcacctttgatgtattancgcctatcgacctacgtcggggtcccgacgaaacgccgtaccggaagggggaacgggtcccgtaggggtacggttcggggtcctacggtaaggggtttagtttagggttagggtaaaagttagggtaggggtacgtacgtaaggtacggggtcttaacggtcgggaccggtacttcggttagggtacggggaaacggggtcccgtattacccgaaccgtattcccgtaccgaagaacgaaccgaaaccgaccaaacggtaacccttccccgtagttaacttcctaacggtacctaaaagtccgaaacgtacggtaccgtaaggaacggtacggtaccgtaaggggaaccgggtaaacccgtaaccggggttaccgtttaagggtttaacttttaggttaacgggtaacgaaaaccgtaaaaacggtaaccctttaaacccccgttaaaacccccggtttaaggtttaacgggtttttacggggtaaacggttttaaccgggg

SEQ ID NO: 313567 - DNA, 649 bp, Homo sapiens
  misc_feature: GZ8MTXP02ISH4J.13.55.E11.1.454.CMB.2.raw
  modified_base (309)..(309): a, c, t, g, unknown or other
  misc_feature (309)..(309): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggtcgttagggtaaacggccggggggttcccttcgacgttctcctgtgcagcctcgtggaatcactttcagtcgacgcctggatgaacgtgggtccncgaggctccgaggggagggcgtggagtggagttgggacgtaagttaaaaaggtgagccgtgagtgggtaggaccaagagactacgctacgccaccggtagaacgggcaagtattaccacctattaccaccaagaagtataggaacttacgaaaaggaaccaactaggttagtttcctaggaactaaagtagaacaacgtccgtaggaccgtcgggaccgggaaccacgtcggtaccgtagttaacttaaccgtgtcggacccaaggacccaggactaacgtacccgtaacggtaccctaatttacgtttaattttttcgtaacgtttcggtaaccggggg

SEQ ID NO: 313568 - DNA, 684 bp, Homo sapiens
  misc_feature: GZ8MTXP02IL6YM.13.55.E11.1.454.CMB.2.raw
  modified_base (383)..(383): a, c, t, g, unknown or other
  misc_feature (383)..(383): n is a, c, g, or t
  modified_base (398)..(398): a, c, t, g, unknown or other
  misc_feature (398)..(398): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtccttcgactctcctgtgcagcctctggaatctactttcagtgacgcctggatgaacgtgggtcccgccgaggcctaccgaggggaacggggcgtaggaggtggagttggccgtaattaaaagtgagccgtgagtgggtaggaccaanacgactacgctcgcncccggtaggaaacgggcaaggtacttaccacctactacctaccgaagagatgaattaccgaaagggtaaaccaacgtaacgttgtttaccgtaaggtaacctaaagttacgaaacgacgtacccgttaggaaccgttccgggacccgggggactaccggtacgtaccggttacgttaacgtttaacgtcggttcgccaacggaccgacggacctaacggtaacccgtccggtacctaacgtttacttttaacgttttttcggaaccgtttttaccgggaccggggg

SEQ ID NO: 313569 - DNA, 553 bp, Homo sapiens
  misc_feature: GZ8MTXP02GF4P2.13.55.E11.1.454.CMB.2.raw
  modified_base (276)..(276): a, c, t, g, unknown or other
  misc_feature (276)..(276): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaacttatttgaattggtatacaaacaaaaaccaggganagcccctcacctccttatctatggtgcatccacttacaaagtgggtcccatcaaggttcagtgcacgtggactcgtgggcagtatttccactcctcaccatcagcagtctgcaacctgtaagtattttgactaacttattactgtacaaacagtagtttacagtacgcggtacgttcgccgaaagggaccgaaaggttacggaaaactacgaaaacgaacgttaggacgtactaggacaaccgtaatcttacgttacttactaccttctttcccccg

SEQ ID NO: 313570 - DNA, 695 bp, Homo sapiens
  misc_feature: GZ8MTXP02JK8OT.13.55.E11.1.454.CMB.2.raw
  modified_base (299)..(299): a, c, t, g, unknown or other
  misc_feature (299)..(299): n is a, c, g, or t
  modified_base (366)..(366): a, c, t, g, unknown or other
  misc_feature (366)..(366): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggagcttgggtacagcctggcaggtccctgagactctcctgtgcagcctctggattcacttgatgattatgccatcgcacgtcgggtccgnaagcctcgaaggggaaggccctggacggtgggtctcgagggttattaggttaggaattgtgggtacncgaagttaggggccttaagtcggacggtactcgtaggtacgggaaacggggccgtacttccaacctatcccgtacgaacgacggaaccaaaccgacccgaaacgtaaacccttcccctaaggttacctacgttacgaacctaaaagtacgaaaccgacggtacccgtagaacggtacgacgtaggggaacggaccgtaaacccggggtcctttaacggttaactttacgtttacgggtacaaaaccggttaaaaacgtacccgttaaacccccttaaaacccccgtttaaggttaaccggttttttaacgggaccggttttaaaacggg

SEQ ID NO: 313571 - DNA, 617 bp, Homo sapiens
  misc_feature: GZ8MTXP02F1EVA.13.55.E11.1.454.CMB.2.raw
  modified_base (221)..(221): a, c, t, g, unknown or other
  misc_feature (221)..(221): n is a, c, g, or t
  modified_base (378)..(378): a, c, t, g, unknown or other
  misc_feature (378)..(378): n is a, c, g, or t
  modified_base (500)..(500): a, c, t, g, unknown or other
  misc_feature (500)..(500): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttcctttggcttattttaaaaggtgtccagtgtgaagtgcagctggtggagtcgtgggggagcttggacngcctggcaggtccctgagactctcctgtgcagcctcgtggattcactttgatgattatcgccatgcacgtcggggtaccgacaagcctaccggaggggaacggcccgtagggaggttcgggtctcgtaaggttattaggttaggaattaggtggtancagtagggctagtggccgtacttcgtaggtaggaacggggaccgtattaccaacctatccgtacccgagaacgaaccaaacgacccaaagtaacccgttcccctagtacttcagaactaaanacgaacgactccgtagacgagcgtaggacgaacgtaccggtctttagtaactttagtagactaaacgaaaacgtactacccgtaaacccgttagttacgttttacggagtttaacgg

SEQ ID NO: 313572 - DNA, 622 bp, Homo sapiens
  misc_feature: GZ8MTXP02IJQMR.13.55.E11.1.454.CMB.2.raw
  modified_base (263)..(263): a, c, t, g, unknown or other
  misc_feature (263)..(263): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggctattttaaaaggtgtccagtgtgaagtgcagctgggtggagtcgtgggggaggcttggtacagcctgggcaggtccctgagactctctgtgcagtccctntggtattcacctttgatgattatgacctatgctacgtcggggtcccgacaaggccgtacggaaggggacggtcgtgggagtcgggtactgaaggttattaggtaggaatagtcggtagctagtgggctagtcggacgtaccgtgtaggtaggacgggtccagttccactatccgtacaagaacgacgaaaccgacccaaagtaccctcccgttagtacttcgtagacctaaaatacgaacgacgtaccgtaggaacgacgacgtaggacgtaccgtacggtcctttaggttaatttagtacgttagaactaaaacgtctaacccgtaacccgttagtttacgtttaggttacgttacgg

SEQ ID NO: 313573 - DNA, 705 bp, Homo sapiens
  misc_feature: GZ8MTXP02H02F6.13.55.E11.1.454.CMB.2.raw
  modified_base (299)..(299): a, c, t, g, unknown or other
  misc_feature (299)..(299): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggagcttggtaaaggccggggggtcccttcgactctcctgtgcagcctctggaatcactttcagtgacgcctggatggacgtcgggtccnccgaggcctaccggaggggaacgggcgtgggagtggtagttgggtaccgttaaagttaaaaggtggacgtcctaggagtgggtaggaccaacgacgactacgctcgacccaccggtggaacggcagtacttccactactccgtacagagagtagtaattacgaaacggaactaacgtaggtttcgtttacgtaacgtaacctaaaagttagaaaccgtacggtacccgttacggaacccgttccggggaacccggggtaccgaccgttacggtacccggttaagtttaacgtttaacccgtggttacgacccgtaacggaccgtacgaccgttaacggtaccgtcggtacctttaacgtttacgtttttactttttaccggaacgtttttccgggtaacccggggg

SEQ ID NO: 313574 - DNA, 565 bp, Homo sapiens
  misc_feature: GZ8MTXP02GY0TW.13.55.E11.1.454.CMB.2.raw
  modified_base (220)..(220): a, c, t, g, unknown or other
  misc_feature (220)..(220): n is a, c, g, or t
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcacatcacttgccggnaagtcagagcattaccaactattgaattggtatacaaacaaaaccagganacgcccctcacctcttatctatggtncatccaacttacaaagtgggtcccatcgaaagttcagtgcactggatcgngggacagtattcactcncacatcancagtctgactaacctgaaatatttagacttaaactttattactagtactaaacgtagtacgtttacaagtaccggtacggtacgttcgggaccaaaggggtacctaaagggtacggaaaactacgaaaacgaaacgtcggtacggtactacggacaacctagtacgttacgtcttacgacttccgtttaccccg

SEQ ID NO: 313575 - DNA, 623 bp, Homo sapiens
  misc_feature: GZ8MTXP02JKX35.13.55.E11.1.454.CMB.2.raw
  modified_base (260)..(260): a, c, t, g, unknown or other
  misc_feature (260)..(260): n is a, c, g, or t
  modified_base (359)..(359): a, c, t, g, unknown or other
  misc_feature (359)..(359): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagcttggtacagcctggcaggtccctgagactctcctgtgcagcctntggattcacctttgatgtattatcgccatgcacgtgggtccgacaagcctaccgagggacggctggagtggtcagaggtattaggtgtaatagtggtanctagtggcttagcgacgtactcgtgtacgggaacgggcctaattacccaactactccgtacccgaagacgaaaccgaaccgtaccaaaacgtaacccttacccgtatacgttcgtacgaaccaaaagtacgaacgacgaccgtagaggacacgaggaacggaccgaccggtacgttagttaacgtttacgtaggttacgaaacgtaaaacgtaccttaaccccgtaaaccccgttagtttagttttaccggtaggtttaaccgg

SEQ ID NO: 313576 - DNA, 754 bp, Homo sapiens
  misc_feature: GZ8MTXP02HZZ42.13.55.E11.1.454.CMB.2.raw
  modified_base (613)..(613): a, c, t, g, unknown or other
  misc_feature (613)..(613): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtatttttccttttggcttaattttaaaaggtgtccagtgtgaagtgcagcgtggtggagtcggtgggggagtcgttggtacagtccgtgggctaggtccctggagtaccttctccgtgtcgcacgtcctcgtggtacttctacctttgatgtattatcgacctatcgctacggtcggggtcccgacaacggtccgtaccggaagggggaacggtccgtaggggtacgggttcgggtaccgttaggtaaggttaagtttaacgggttagggtaaaagttgggtagggtaagcgtaaggttcgggacgttaagtcgggtaccgtacgttcggtgggttaacggggaaacgggtccgtacgttaccgaacctagtacccgtacaacggaacgaaccaaccgacaaacgtaaccttccgtagtacttacgtacgaactaaatacgaaacgacgtaccgtaggaggaacncggtacggaacgggaacctacgggttcctttaaggttaacgtttacgttacggttacgaaaaccgtaaaaaccggttaccttaaaaccccgtttaaaccccgtttaagttttacgggttttagggtttaacggtttaacgg

SEQ ID NO: 313577 - DNA, 593 bp, Homo sapiens
  misc_feature: GZ8MTXP02IL8KG.13.55.E11.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (322)..(322): a, c, t, g, unknown or other
  misc_feature (322)..(322): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagagtcaccatcacttgccgggnaagtcagagcaacttaccaacttattgaattgtatacaaacaaaacgaggacacgcccctcaccctccttatctagtggtcgctactacctaaccttaanaaaggtggactacccatacgtaaggtcagtcgctacgtggactcgtggggtacagtactttcgaccttcaccacctatcgagtactacgtctacgactaaccgtagtaaacgttatttcgaaccttaaactttacgttactacgtactaacgtagtacgtttacgaggtaccgtcgggtaccgttcggaaccgaagggaccgtaagggtacgaaagtaccaaaaggtacgtgtacggctagaactaccgtatcgtatccttacacttcccg

SEQ ID NO: 313578 - DNA, 621 bp, Homo sapiens
  misc_feature: GZ8MTXP02GRLI5.13.55.E11.1.454.CMB.2.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (309)..(309): a, c, t, g, unknown or other
  misc_feature (309)..(309): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagagtcaccatcacttggccggganaagtcagagctattaccaattattgaattggtaatacaaacaaaaccgaggacacgcccctacacccttcctatcttagtggtanactactaccctaaccgttaacgaaaggttcggggtacccctaagtacgaaacggtttcacggtcgactacgtggactcggtagggactagtactttccacctctacaccgactcagacctagtcagacctaaacgtgtaaatttacgtttcgacttaacgtttataccgtagtactaacgtagttacgttacacggtacgtacggtacggtacggaccgtaagggtaccaaggttaacgaaaacgttacgaaaaccggtagtaggtaccggctacgaccaacgttacgcttacgtctactcgttacccgtcc

SEQ ID NO: 313579 - DNA, 599 bp, Homo sapiens
  misc_feature: GZ8MTXP02JNKDH.13.55.E11.1.454.CMB.2.raw
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttggtaaaggccggggggtcccttcgactctcctgtgcagcctctggatcactttcagtgacgctggatgacgtggtccgcgaggctccgaggggagggcgtggagtggagtggcgtaattaaaagtgagctgagtggtggaccanagactacgctgcnccgtgaaggcagatcactatctccagagatagaattacgaagaacacgtagtagttactagtacaaagtagaacgacgaccgtagacgtcggacccgggactacgtcgtacggttacgtacgttacgtacgtcggaccgacgtacgacggacctacggtacccgtaacggtacctaaccgtttactttaacgtttttttacgttacgtttccggttaccggggg

SEQ ID NO: 313580 - DNA, 626 bp, Homo sapiens
  misc_feature: GZ8MTXP02GRKD7.13.55.E11.1.454.CMB.2.raw
  modified_base (368)..(368): a, c, t, g, unknown or other
  misc_feature (368)..(368): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttggactgagctggtattttccttttggcttattttaaaggtgtccagtgtgaagtgcagctggtggagtcgtgggggagcttggtacagcctggcaggtccctgagctctcctgtgcagcctctggattcacctttgatgattatcgccatgcacgtcggggtccgacaacgcgtccgaaggggacggccgtaggaggtgggtctgtaaggttagttagtaggaataggtggancgaagttcggctagtcggacgtactcggtgtagggaacggcctaagttcacccgtatccctacgagaacaaccgaaacgaccaaagtaaaccctcctagtaacttcgagaactaaactacgaaacacggtccagaagacgtacgaggaacggacgtaccgggtacctttagttaacgtttgttaacgtcgaaaacaaaacggttccctaaacccgttaaaccccttaggtttaacgttttacggtaacggtttaacgg

SEQ ID NO: 313581 - DNA, 776 bp, Homo sapiens
  misc_feature: GZ8MTXP02JK3GQ.13.55.E11.1.454.CMB.2.raw
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttcctttggcttaattttaaaaggtgtccagtgtgaagtgcagcgtggtggagtcgtgggggagtcgttggtacagccgtgggccacgggtccctggacgtacctccttcctggtcgcacgtccctcgtggtacttcacctttgatgtattatcgaccagtgctacgtcgggtccgacaagtctacggaggggaacggcccgtagggagttcgggtcctacgtagggttacttagggtttaggaagttaggtagggtacgtacgaagttagggtccgtaaggttcggaccgggtaccttacggtagggtaacgggtaacggggtaccttaacgttcccaaaccgtactttcccgaccaacgggaaccgaaaccgaacccgaacccgaaacggtaaaccccttcccgttaacggttacctaccgttacggtaaaccaaaacgttcgaaaaccgacggttaccgaaggaacggtacggacccgttaagggaaaccgggaccgttaacccggtaccgtttaaggttaaccgtttacgttaagtacgaaaacctaaaacggtacccttaaaacccccgtaaaacccgtttacggtttaaacggttttacgggtaacggttttaaacgg

SEQ ID NO: 313582 - DNA, 669 bp, Homo sapiens
  misc_feature: GZ8MTXP02JOM42.13.55.E11.1.454.CMB.2.raw
  modified_base (198)..(198): a, c, t, g, unknown or other
  misc_feature (198)..(198): n is a, c, g, or t
  modified_base (315)..(315): a, c, t, g, unknown or other
  misc_feature (315)..(315): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatccctccctgtctgcatctgtagganacagagtcaccatccacttggccgggacaagtcagagctaattaacccaattattagaattggtaatacaaacaaaaccgagggagacgccccctacacccttcttatctagtggtnacactaccaacctttaacgaaaggtcgggtacccatacgaaaggttcagtcggactacgtaggatacggtagggactagtactttccactctacacatcagacacgtctacgacctaacgtgtaaacttagttttacgacttaaacttttacttacgttaacgtaacctaaacgtagttaacgtttacgaggttaccggtaccgggttacggttaccggaaccgtaaacggggaacccgtaaaaggggttaacgaaaacgttaacggaaaaccggtaacgtaggtaccggtacgttacgaaccgtaaccacgttaccgttaggttcccttactaccgtttaccctttaccccgg

SEQ ID NO: 313583 - DNA, 781 bp, Homo sapiens
  misc_feature: GZ8MTXP02IIUOE.13.55.E11.1.454.CMB.2.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (338)..(338): a, c, t, g, unknown or other
  misc_feature (338)..(338): n is a, c, g, or t
tcagtcacgtactacacgaccggtgctcgatttagcactcgcacgttgggtttgggggggtcacaagaggcagcgctctcgggacgtctccaccatggcctgggctctgctgctcctcactctcctcactcaggacacagggtcctgggcccagtctgccctgactcagcctgcctcatgtctggtctctggacngtcgatcacntctcctgcatggaaatgcagtgtatggtggacttatgtacttgtctccgtggtaccgacaacacccaggaccaaacgaccccaactctagtttacgtacgggtacaacgtaacgcgccctagacggtctttcngtactcgtcttccctcgtcggtctaccgaacgttcgtacggccaaaccgtccggtccccttaccccgttacgaaccctaaaccgtttccctaccggttaccggtaacccgttaccccggaaccggggtacccggaacggggaccgggaacgggttcccgtttaaggtttaacgtttttaccgttggttttacggtttacgttaatttaggttaccgacgggtaaaggggtaagggtacgttaggttaagtttaacgtggtttaccggttttaaggggtaaacggtaacggggttaaccgtaaaacgggtttcccgtaaacccgggtttccggtttacgggacccgttaccggtaaacccccggaaaccgggttaacccccaaaccccggttacttaacccggtcccttaaccccggtttacctttccccggtttaaccccccc

SEQ ID NO: 313584 - DNA, 670 bp, Homo sapiens
  misc_feature: GZ8MTXP02GUBOK.13.55.E11.1.454.CMB.2.raw
  modified_base (297)..(297): a, c, t, g, unknown or other
  misc_feature (297)..(297): n is a, c, g, or t
tcagtcacgtactacacgaccggtgctcgatttagcactcgcacgttgggtttggggagctctgggagaggagccccagccctgagattcccaggtgtttccattcagtgatcagcactgaacacagagactcaccatggagttgggactgagctggtatttttcctttggcttaattttaaaaggtgtccagtgtgaagtgcagcgtggtggagtcgtgggggagtcttggtagagccgtggcaggtccctgagactctctgtcgcagcctctggacttcactttgattgatttangcctatcgctacgtcggggtccgacaaggcctaccggaaggggaacggtccgtaggggagtcggggttactaccggtaggttagtttaggttagggaaagttagggttagggtagctaaagttacggggacttaaggtcggacggtacttcgtaggtagggaacgggtacccgtattacccaaccgtactactaccgaaagaccgaaaccaaaccgaccaaagtaccctacccgtagtacctactacgaacaacgtacgaaccacgtaccgtagaacgacgcgtaggacggtacctacggtaccgtttagttagttagttggaacgtaaacgtaaaacgtacctaacccgttaaaccccgtttagtttaacgg

SEQ ID NO: 313585 - DNA, 530 bp, Homo sapiens
  misc_feature: GZ8MTXP02FEKF4.13.55.E11.1.454.CMB.2.raw
  modified_base (298)..(298): a, c, t, g, unknown or other
  misc_feature (298)..(298): n is a, c, g, or t
  modified_base (429)..(429): a, c, t, g, unknown or other
  misc_feature (429)..(429): n is a, c, g, or t
  modified_base (463)..(463): a, c, t, g, unknown or other
  misc_feature (463)..(463): n is a, c, g, or t
  modified_base (471)..(471): a, c, t, g, unknown or other
  misc_feature (471)..(471): n is a, c, g, or t
  modified_base (490)..(490): a, c, t, g, unknown or other
  misc_feature (490)..(490): n is a, c, g, or t
  modified_base (499)..(499): a, c, t, g, unknown or other
  misc_feature (499)..(499): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtctgggggagcttggtacagcctggcaggtccctgagactctcctgtgcagcctctggattcacctttgatgattatgccatgcactggggtccggnaagctccaggggaagggccctgggagttgggtctcaggttattaggttggaaatagtggtagcaatggctaatgcgactctgtgaaagggccgattcaccatctccagagacaacgccaaagaacctcccngtatctgacaaaatcgaaacagccctgagagtcngacggacncggaccttgtaattattgngacaaaagntacccaaacccttcgtattttcggatttagg

SEQ ID NO: 313586 - DNA, 806 bp, Homo sapiens
  misc_feature: GZ8MTXP02F2N3S.13.55.E11.1.454.CMB.2.raw
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttcctttggcttaattttaaaaggtgtcctagtgtgaagtgcagcgtggtggagtcgtgggggagtcgttggtacagccgtggctacggtccctgacgactctcctgtgcacgccttcgtggtacttcctacgtttgattgtacttagtcgacctagtcgcctacggtcggggtccgacgtaacggtcccgtaacgggaagggggtaaccgggtcccggtaggggtaacgggttcgggttacctacggtaaaggggtttaacgtttaacggggttagggtaaaagttaggggttacgggtaacggtaccgttaaagggttacgggtacttaagggtcggggaccgttaccgttagggtacggggtaacgggtaaacgggggtaccttaaacgttacccgaaacctacgttacccgaaccgaaacggaaccgaaacccgtaaaccgaaacccgtaaactaaaccccgttacccgtataccgttacacgtaaaaccaaagtaccgaaacgtacgtaccgtaggaacgtacgtaccgtaagggaacggtaccgtaaacggttccgttaagttacgttagttagtaacgaaaacggtaaacgtaccctaaaacccgttaacccttaggtttaacggtttacggtaacggttttaacgg

SEQ ID NO: 313587 - DNA, 723 bp, Homo sapiens
  misc_feature: GZ8MTXP02FRLAC.13.55.E11.1.454.CMB.2.raw
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggctaattttaaaaggtgtccagtgtgaagtgcagctgggtggagtcgtgggggagtcgttggtacagccgtggcaggtccctggacgactctcctgtgcagccctcgtggacttctacctttgatgtattancgccatgcctacgtcggggtcccganaacgtccgtaccggaaggggaacgggccgtggggaggttgggtcctagtaaggggttatttaggtaggaagtaggtaggtagcgtaagtagggcttaggtggaccgtacgttcgtagggtacgggaacggggtccgtaacgttacccaaccgtactacctaacccgaaggaaccgaaaccaaaccggaaccaaacgtaaaccccttcccgtagttactcctacggaactaaaagtaccggaaacacggtaccgtaggacgacgtacgtaaggaacgggtaccgtacgggttcctttaaggttaacgtttagttacggtaactaaaaccgtaaaaacggtacccttaaaccccgttaaaaccccgtttaggtttaacggtttttacggtaacggttttaaccggg

SEQ ID NO: 313588 - DNA, 741 bp, Homo sapiens
  misc_feature: GZ8MTXP02FQKTX.13.55.E11.1.454.CMB.2.raw
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggtattttcctttggcttaattttaaaaggtgtccagtgtgaagtgcagcgtggtggagtcgtgggggagcttggtacagcctggcaggtccctgagactctcctgtcgcagtcctcgtggtacttcctacctttgatgtattagtcgcctatcgccgtacgtcggggtacccggcaaacggtccgtacccggaagggggtacgggcccgtaggggaggttcggggtctacgtaggttattagggttaggaaagttagggtaggttacgcgtaaagttacggacgttagttacggggccgtaacgtttcggttagggtacgggtaaacgggggtacccttacgttacccgaaccctacgttacccgtaacccgaacgggtaaaccgaaacccgaaaaccccggaaccccgtaaaacggttacccccttaacccccgttggttaaaccctaccgttacgaaaccgtaaaagttacgaaaccggtacgacccgtagaaggtaacggccgtaagggacgaccgtaacggttccttagtacttaagtcgtaagaactaaaacgcctaccctaaaacccgttgtttaagg

SEQ ID NO: 313589 - DNA, 550 bp, Homo sapiens
  misc_feature: GZ8MTXP02JING2.13.55.E11.1.454.CMB.2.raw
  modified_base (296)..(296): a, c, t, g, unknown or other
  misc_feature (296)..(296): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtctgggggagcttggtacagcctggcaggtccctgagactctcctgtgcagcctctggattcacctttgatgtattatgcatgcactgggtccgnaagctccgagggaggcctggagtgggtctcgagtattagtgaactagtggtancgatcggntagtgcgtactgtgagacggctatcacntcacgagacgacgaacgacaacgacctacctagtactacgtagacaaatacgaaacacgtcgtagagagacaggaacggacgtacggtccttagttaacttacgttacgtacgaacgaaacgtacgtaaccccgtaacccgttagttacgttttacggagttacg

SEQ ID NO: 313590 - DNA, 815 bp, Homo sapiens
  misc_feature: GZ8MTXP02G6H79.13.55.E11.1.454.CMB.2.raw
  modified_base (290)..(290): a, c, t, g, unknown or other
  misc_feature (290)..(290): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggcttaattttaaaaggtatccagtgtgaagtgcagctggtggagtcgtgggggagcgttggtacagccgtggcacggtccctgacgactctcctgtgcacgcctcgtgtattctactttgatgtattancgaccagtcgctacggtcggggtacccgacaacggccgtaccggaagggggtaaccgggtcccggtagggtacgggtcgggtactacggtaaggtttagttaacggttagggtaagttaggtagggtagtacctaaggtacgggcttaaggtcggtaccggtaacttcgggtagggttacgggggaaacccgggtcccgttaaacgtttacccaaacccgttacgttacccgaacccgaaacgggaaccgtaaaaccccgaaacccgtaacccgaaaaccggttaaccccttacccccggtttaaggttaaccctacggttaaaccggaaaccgtaaaattaaccgaaaccgttacggtacccggaggaaaacggtccgaacggttacggaaaaccgggtacccgtacggggtttaccctttaggttaacctttaaggttacgtaacgtaaaactaaaaccggtacccttaaaccccgttaacccgtttaaaggtttgttttaaccggggaagttttaaccgggg

SEQ ID NO: 313591 - DNA, 732 bp, Homo sapiens
  misc_feature: GZ8MTXP02ITRVI.13.55.E11.1.454.CMB.2.raw
  modified_base (221)..(221): a, c, t, g, unknown or other
  misc_feature (221)..(221): n is a, c, g, or t
  modified_base (377)..(377): a, c, t, g, unknown or other
  misc_feature (377)..(377): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaggtgtccagtgtgaagtgcagctggtggagtcgtgggggagcttggtacngcctggcaggtcctgagactctcctgtgcagcctctgtacttctacctttagatgattatcgccatcgcacggtcgggtccgcaagcctacggaaggggaacgggtcctagggacgtcgggtactcgaaggttatttaggtacggaatagtggtanactagtagggtctagtggaccggtacttcgtagggttacgggaacggggtccgtaaagttccaaaccgtacttaccgtacccgaaacggaacggaaacccgaaacccgaacccgaaaacggtaaaccccgttaccccctttaaggtaaccgtttctaaccgaaacgttaaaacgtaacggaaacctaaacggtacccgttaaggaacggaccggttagtaacgggacggaaacccggtcggttaccttttaacggttaacgttacgtttacgggaactaaacgtaaaaaccgttcgtaaaccccctttaaaacccggttacgtttacggtttttaccgggaagtttttaaccggg

SEQ ID NO: 313592 - DNA, 561 bp, Homo sapiens
  misc_feature: GZ8MTXP02GWL9G.13.55.E11.1.454.CMB.2.raw
  modified_base (302)..(302): a, c, t, g, unknown or other
  misc_feature (302)..(302): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcacctttgatgattatgccatgcacgtgggtcccggnaagctccgaggggaggccgtggagtgggtctcgaggttattaggttaggattaggtggtagctagtgggctagtggcgactcgtgtaggaaggccgtattcgacatctcagagacaacgaccaacgaactccctagtactcgtagacaaatacgaaccagcctagagagcgaggacggaccgaacggtccttagttacttagtgtacgacaaaacgtctacccgtaaccccgttagtacgttttaggtacgtttaacgg

SEQ ID NO: 313593 - DNA, 617 bp, Homo sapiens
  misc_feature: GZ8MTXP02GQGLY.13.55.E11.1.454.CMB.2.raw
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagcttggtacagcctggcaggtccctgagactctcctgtgcagcctctggattcacctttgatgtattatcgcctatcgcacgtggggtccgacaagcctccgaggggacggcctgggagtggtctcgaggttataggtagaataggtggtagcagtggctagtcggcgtactcgtggtggaaacgggtcctattccactactcctacagacgaaccaacgaccaaacgaaccctccgtagtactcgtagaaccaaatacgaaacgacgtaccgtaaggacgagacgtacggaacggaccgtacggtaccgtttaggttaactttacgttagtaacgtaacgtaaaaacgtccttaaaccccgtaaaccccgtttaacgttagtttttacgggtagttttaacggg

SEQ ID NO: 313594 - DNA, 545 bp, Homo sapiens
  misc_feature: GZ8MTXP02JWGM1.13.55.E11.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (517)..(517): a, c, t, g, unknown or other
  misc_feature (517)..(517): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagagtcaccatcacttgccgggnaagtcagagcattaccaacttattgaattggtatacaaacaaaaccgagganacgcccctcaccctcttatctatggtncactccaactttacgaaagtcgggtacccagtacaaggttcagtgcacgtggatcgaggcagtacttcactctacacntcagcagtcnaccactgaatntttanactaattatactgtacaatagtagtttacagtaccggcggtaacggttcgacgtaagggaccaaggtacggaaaactaccaaaaccggtagtcggtacggactgaccaactntccgttatcctactacctccgttacccc

SEQ ID NO: 313595 - DNA, 612 bp, Homo sapiens
  misc_feature: GZ8MTXP02FVNDG.13.55.E11.1.454.CMB.2.raw
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatccctccctgtctgcatctgtaggagacagagtcaccatcacttcggccgggcaagtcagagactacttaccaacttatttgaattgtatacaaacaaacgagganacgcccctcacctcttatctatgtncactccaccttaacgaaggtcgggtacctagtctaacggttcacgtcggacagtggtatcggtgggactagtactttccgactcttccaacctactacagtcacgtctacgacaaaccgtagtaagttatttacgacttaaatttacgttaactacgtacaaactacgttaacgtttacaacggtaccggtacggtacggtttacgggaccgtaaacggggtaccgaaagggtaacggaaaacttacgaaaacgtaaacgtggtacgcgtcgacctaacgaactcgtcgttacttcaactccttacccg

SEQ ID NO: 313596 - DNA, 745 bp, Homo sapiens
  misc_feature: GZ8MTXP02HM3YL.13.55.E11.1.454.CMB.2.raw
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (281)..(281): a, c, t, g, unknown or other
  misc_feature (281)..(281): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggagcgttggtacagcctgggcaggtccctgagactctctgtncngctctggattcactttgatgtattangcctatgcacgtggggcccgacaacgtccgtaccggaggggaacgggcccgtaggggtacggttggggtacctcgaagggttagtttaaggtggaattagggtaggtacgacgtagtcggggtacttaagtggccgtacgttcgtagggttagggaaacggggtccgtaaacgttcccgaaacccgtagttaccctacccggaacgtaacgaaaaccccgaaaccgggaaccctaaaacggttaaaccccggttaccccctttagggtttaaccttaccgttacggaaaccaaaacgttaacgaaacgttaccggtaccgtaagggacgttacggacgttaggggaaccgtacggaccgggttcctttaaaggttctttaacggtgtaacgaaacgttaaaaccgtaccgttaacccctttaaaacccgttagtttagttttacggggttaacgtttaacgggg

SEQ ID NO: 313597 - DNA, 685 bp, Homo sapiens
  misc_feature: GZ8MTXP02HMSAB.13.55.E11.1.454.CMB.2.raw
  modified_base (312)..(312): a, c, t, g, unknown or other
  misc_feature (312)..(312): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagcttggtacagcctggcaggtccctgagactctcctgtcgcagcctcgtaggtattccgacctttgatgtattatgcctatgcacgtcgggtccganacgcgtaccgaggggaacggcccgtagggagtcgggtctcgaggttattacggtgaagttggttgggagacgtagtacgggacttaagtcggacgggtaacttcggtagggttacggaacggggtcccgtacgttacccaacctattcccgaccaaacggaacgaacccgaaaccggaccaaacgtaacccttaccccgtagttaacttacgtacgaactaaacgtacggaaaccacgtaccgtaggaacgtacgcgtaaggacggtaaccggtccggttactttaggttaacttaggttactacggaaacctaaaacggtaccctaacccgttaaccccgtttagttacggttttagggtaacgtttacggg

SEQ ID NO: 313598 - DNA, 551 bp, Homo sapiens
  misc_feature: GZ8MTXP02H98JO.13.55.E11.1.454.CMB.2.raw
  modified_base (301)..(301): a, c, t, g, unknown or other
  misc_feature (301)..(301): n is a, c, g, or t
  modified_base (394)..(394): a, c, t, g, unknown or other
  misc_feature (394)..(394): n is a, c, g, or t
  modified_base (430)..(430): a, c, t, g, unknown or other
  misc_feature (430)..(430): n is a, c, g, or t
  modified_base (456)..(456): a, c, t, g, unknown or other
  misc_feature (456)..(456): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaggtgcagctggtggagtctgggaggaggcttgatccagccgtggggggtccctgagactctcctgtgcagcctcgtggggttcaccgtcagtcacactacatgagcgtgggtccncgaggctccgaggggaaggggctggagtgcgtcttcttttatatagtagtgtagtacatactccgcagactcggtgacggggccatcacatcncagacgaacaataccaagaacacgtcttgttcctanaaatgaaactgctagagagaccgtancgaccgacggtccgtagtacttacgtgtcgacgagagacgtacgggggccccaaggaacgtttacgaacgtctaagtcggtacgtcggaacgggg

SEQ ID NO: 313599 - DNA, 604 bp, Homo sapiens
  misc_feature: GZ8MTXP02H771D.13.55.E11.1.454.CMB.2.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (425)..(425): a, c, t, g, unknown or other
  misc_feature (425)..(425): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctcctgtctgcatctggtagganacagagtcaaccatcacttcggccggganaagtcagagctaattaaccaattattagaattggtaataacaaaacaaaaccgaggacaccgcccctactacctcttatctagtggcacactaccctaactaacgaaaggtccgggtaccagtacgtaacggttcaggtcggactacggtagtactccggtagggtacaacgttactttacctacctctacaaccttancaaacgtcgtaacgtctacgaccctaaacgtaggtaaacttatttacgaaccttaaattactaccgtatactaacgtagttacgttagacgtacgcggtacgtcgaaccgaggaacgtaagtacgaaatacgaaacgtcngtacgacncgacaacactcgtactctacaccttctcccg

SEQ ID NO: 313600 - DNA, 764 bp, Homo sapiens
  misc_feature: GZ8MTXP02GQD6T.13.55.E11.1.454.CMB.2.raw
tcagtcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggtattttcctttggcttaattttaaaaggtgtccagtgtgaagtgcagctggtggagtcgtgggggagcgttggtacagccgtggcaggtccctgacgacctctcctgtcgcagcctctggtattcacctttgatgtattatcgacctatcggacctacggtcggggtaccccggacaaacggtcccgtacccgggaagggggtaaccgggtcccggtaggggtaggttcggggtactaccggtaagggttaagtttaggttagggtaaagttagggttcgggtagtcgtaaaggttacgggtaccttaaggttcggacgggtaccgttcgttagggtacgggtaacgggtacccggtaatttaccccgaaaccttacgttacccgtaccgaaacggacgaaaccgtaaaccgaacccgtaaaacggtacccttacccgttagttactacgtacgaaacctaaagtacggaaactacggtaccgaggaacgtaagcggttacggacggtaaccgacgggtttaccttacgttaagtttaacgtgggttaacgaaaacctaaaacggttacccttaaaccccgtttaacccgtttaagttttaacggg

SEQ ID NO: 313601 - DNA, 684 bp, Homo sapiens
  misc_feature: GZ8MTXP02JCBWN.13.55.E11.1.454.CMB.2.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (650)..(650): a, c, t, g, unknown or other
  misc_feature (650)..(650): n is a, c, g, or t
tcagtcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagagtcaccatcacgttgccgganaagtcagagcattaccaatatttgaattgtatacaaacaaaacgaggacgacgcccctctaccctctttaatcttaatggtcacacttacccaaccttaaaccgaaaggttcgggtaccccagttaccgtaaagggtttcaacggttcggacctaacgttacgggtagttacccggttaggggactaagggttaacctttttaccaaccgttacccttaacaaacctaacttaccgaacgctaaacggtctacggaaccgtaaaccctaggtaaacgttaagtttttcgaaccttaaatttaacgttactacgttaacgaactagttacgtttacaagttacgacgggtacgttacggaccgaaacgggaacaaaggtaacgaaaacgttacgaaaacgtaacgtacggtagacctacggaccaacncgtacttgtacctttacaactttcccgtaccccg

SEQ ID NO: 313602 - DNA, 657 bp, Homo sapiens
  misc_feature: GZ8MTXP02HV8FN.13.55.E11.1.454.CMB.2.raw
  modified_base (303)..(303): a, c, t, g, unknown or other
  misc_feature (303)..(303): n is a, c, g, or t
  modified_base (396)..(396): a, c, t, g, unknown or other
  misc_feature (396)..(396): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggagtcgttgggtaaaggccgggggtcccttcgactctcctgtgcagcctctggaatctactttcgagtgacgcctggatgaacgtgggtcccnccgaggcctaccgaggggaagggcgtggagtggtagttggacgttaattaaaaggtgagtcctgagtgggtaggaaccaacgacgactacgtntccgaccgacccggtagggaaacggcaacgtacttaccaacctactcctaccgaaggagtatagtaacgttaacgaaacggtaaacaacgtagttacgttacgtagttacgaaaacttacgaaactacgtaccgtacgacgtcgggaccgggtaacgacgttcgaccgtagttacttactcggtacgaccacggcacggactacgtaccgtcgtaccttaactttagtttacgtttttacgtaccgtttacggtaccgggg

SEQ ID NO: 313603 - DNA, 761 bp, Homo sapiens
  misc_feature: GZ8MTXP02FLWYI.13.55.E11.1.454.CMB.2.raw
  modified_base (268)..(268): a, c, t, g, unknown or other
  misc_feature (268)..(268): n is a, c, g, or t
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggcttaattttaaaaggtgtccagtgtgaagtgcagctgggtggagtcgtggggggagtcgttgggtacagccgtggcacggtccctgagactctcctgtgcagcctntgattctcttgatgattatgccatgacacgtcggggtccgacaacgccgtaccggaaggggaaccgggtcctaggggtacgggttacggggtcctaggtaagggtttagtttaacgggttaggtaaagttaggggtacggttaaagccgtaaagttaggggcttaaggttcggaccggtaaccttggtagggtttacgggaaacggggtacccgttaacgttaaccctaacccgtacttacccgttaccgaaggaaacgaaacccgaaacccggaaacccaaaacgtaaaaccccgttcccttaacgttaactacgttaacggaaactaaaattaacgaaaccgtagacccgttaaggaacgtacggagtacgggaacggaaccggtaacggttaccgttaggttaattacggtttagtaacgtaaacgtaaaacgtaaccgttaacccgttaaaccccgttagttttacggtttagggtacgtttaaacggg

SEQ ID NO: 313604 - DNA, 567 bp, Homo sapiens
  misc_feature: GZ8MTXP02JG99M.13.55.E11.1.454.CMB.2.raw
  modified_base (301)..(301): a, c, t, g, unknown or other
  misc_feature (301)..(301): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctatttaaaggtgtccagtgtgaggtgcatctggtggagtcgtggggaggcttggtaaaggccggggggtccttcgacgtctcctgtgcagcctcgtggaatctactttcaggtgacgcctagggataggactgggcccncagggctccgaggggaacggctggagtggattggcttaagtaaaagngatcgtagntggtaggactacagacagtcngcnccggtgacggnagntacacagtcncagtagatcgatacgaagacagtagtctntacgaaanagtacanagcagcgcggacggactgtcgacgtagtacttacgtcgtacgaccgacgacgacgaccgtaccgtaccgtaacgtaccttaacgtttacgttttacgtttacgaccgtttcggaccgg

SEQ ID NO: 313605 - DNA, 797 bp, Homo sapiens
  misc_feature: GZ8MTXP02JD69B.13.55.E11.1.454.CMB.2.raw
tcagtcacgtactacacgaccggtgctcgatttagcactcgcacgttgggtctgggagaggagccccagccctgagattcccaggtgtttccattcagtgatcagcactgaacacagaggactcaccatggagttgggactgagctggtattttccttttggcttaattttaaaaggtgtccagtgtgaagtgcagctgggtggagtcgtgggggagcgttggtacagccgtggcacggtccctgagacctctccgtgtcgcacgtcctcgtggtacttcctacctttgatgtattatcgactatgctacgtcggggtccgacaacgccgtcggaaggggacggccgtgggaggttcggtctacgaggtttagttaggttaggtaaacgtggtagggtacgacgtaagtacggggtacttaagtcgggtaccgtaacgttcggttaggggtaacggggtaaaccggggtccctaaacgtttacccgaacccgtaacttccccgtaacgaacgggaaaccgaaaaccccgaaaccgaacccgtaaaaccgtaaaccccgttaccccgttaacggtaaccttacgtactaaacgtaaaacgtaacggaaacctacgggtaccgtaggaacggttacggtacgaacggggaacccggtaaacggtaccggttaccgtttaaagtttaaagtttcgttaaacggtaaccgaaaacgtaaaaacggttaacccctttaaacccccgttaaaacccggttttacgttttaaacggtttttacgggaacgtttttaaaccgggg

SEQ ID NO: 313606 - DNA, 703 bp, Homo sapiens
  misc_feature: GZ8MTXP02F80RO.13.55.E11.1.454.CMB.2.raw
  modified_base (306)..(306): a, c, t, g, unknown or other
  misc_feature (306)..(306): n is a, c, g, or t
  modified_base (367)..(367): a, c, t, g, unknown or other
  misc_feature (367)..(367): n is a, c, g, or t
tcagtcacgtactacacgaccggtgctcgatttagcactcgcacgttgggtctgggagaggagccccagcccctgagattcccaggtgtttccattcagtgatcagcactgaacacagaggactcaccatggagttgggactgagctggattttccttttggctattttaaaaggtgtccagtgtgaagtgcagctggtggagtcgtgggggagtcttggtacagcctggcaggtccctggagactctcctgtgctagcctcgtggattcgacctttgatgattatgccatgcactggggtccganagctaccgaggggaggccctgggaggtggtctcgtaaggtattaggtggaaatgtgggtanactattacggggctagtcgaccgggtattcgtaggtagaaacggggtcctaaacttccaaccatccgtaccaggacgaaccaaacgacctaaaggaaaccctcccgtagttaactcgttacacttaaaacgtcggaaacctacggtacccgtacggaaggtaaacggccgttaggggaaaaccggtaccggacccggggtaccccgttttaagggttaaactttaaacgttttacggggtaaacgtaaaaccgtaaaaaaccggtaacccgttaaacccccgttaaaacccccgtttaaagtttaacggtttttaacggggtaacggtttaacggg

SEQ ID NO: 313607 - DNA, 768 bp, Homo sapiens
  misc_feature: GZ8MTXP02F93MI.13.55.E11.1.454.CMB.2.raw
tcagtcacgtactacacgaccggtgctcgatttagcactcgcacgttgggtttggggggggtcacgaagaggcagcgctctcgggacgtctccaccatggcctgggctctgctgctcctcactctcctcactcaggacacagggtcctgggcccagtctgccctgactcagcctgcctccatgtctgggtctcctggacagtcgatcacatctcctgcactggaaactagcagtgagtgttagggtacttagtgtaccttgtctctaggtaccgaacaaaccacccgaagtaccaaaccgacccccaaaattccaatttaacgtttacggggtacaaacgtaacgccggccctacgagggtctttctgtatcgtcttcctcctggctaccgtaagtctacggccaaacgaccggtccctaccctagaactaatcctcgtacggtaacccttccgaacggcccgtaaagggtaaccgcgggtacttacgtttaattttttaccgaggttttcgttacctaaacgtttacgtacggtacggtaaaaggggtaaacggttacgttaggttaaactttttcgttaacggtttcgtttttaaagggggaaaacgggttacggggttaaacccgtaaaacgggggtttaccgttaaacccggttcccggtttaagggtacccgtaaaccgacccccgttaaaacgggccccgtaaaaacccccggtctttaccggacctaacccgtttcccggtttccctttaaacccccccgg

SEQ ID NO: 313608 - DNA, 724 bp, Homo sapiens
  misc_feature: GZ8MTXP02HPEK3.13.55.E11.1.454.CMB.2.raw
tcagtcacgtactacacgaccggtgctcgatttagcactcgcacgttgggtttggggggggtcacaagaggcagcgctctcgggacgtctccaccatggcctgggctctgctgctcctcactctcctcactcaggacacagggtcctgggcccagtctgccctgactcagcctgcctccatgtctggtctcctgacagtcatcaccatctcctgcacgtaggaaatgacagtgtatggttggtacttagtcgtaccttgtctccgtaggtacccgacaaccacccgagaccaaccgaccccctaaactctaagtttacgtttacgggtactaaagtaacggcccggtcccctacggtacggttcctttcgtacgtacgttccggtcctttcccgtcgtacggtacctaccgtaagtccgtacggacctaaacccggccggtacccttacccgtacgaactaacttcctcgtacggtaccctaccgacgggtacgacggacggacggttcttacgtttaacttttcgtagtttcgtatagttacgtgacggtaagggacggtagtagttattaggttagttacgggttagggtaaggtacgggtaaccgtaacgggttcctaccggtttccggtttacggaccgtacccggaacccgtaccgggaacccctaacccgtacgttacggtaccctaacgtttcccggtttacccgtttaaccccccg

SEQ ID NO: 313609 - DNA, 589 bp, Homo sapiens
  misc_feature: GZ8MTXP02GWOXV.13.55.E11.1.454.CMB.2.raw
  modified_base (198)..(198): a, c, t, g, unknown or other
  misc_feature (198)..(198): n is a, c, g, or t
  modified_base (381)..(381): a, c, t, g, unknown or other
  misc_feature (381)..(381): n is a, c, g, or t
tcagtcacgtactacacgaccggtgctcgatttagcactcgcacgttggggtttgggggagtcagtctcagtcaggacacagcatggacatgagggtccccgctcagctcctggggctcctgctactctggctccgaggtgccaaatgtgacatccagatgacccagtctccatcctccctgtctgcatctgtagganacagagtcacatcacttggccggcaagtcagagcattaccaatattgaattggtatacaaacaaaaccgaggagacgcccctcacctccttatctatggtcgcataccaaccttacaaaggtcggggtacccatcaaggttcagtggcactggatcgagggcagtactttcactcctacaccntcagcagtctagacctaacgtagtaagttaactttgaccttaactttaattacttacgtactaaactaggttacgtttaccgacggttaccgacggttacgttacggacccgtaaagggaccgaaggtacggaaaactacggaaaacgtacgtcggtacgacgtacgacgtaacgacttacgttacgttctactactcctttaccccg

SEQ ID NO: 313610 - DNA, 695 bp, Homo sapiens
  misc_feature: GZ8MTXP02GADO0.13.55.E11.1.454.CMB.2.raw
  modified_base (177)..(177): a, c, t, g, unknown or other
  misc_feature (177)..(177): n is a, c, g, or t
  modified_base (258)..(258): a, c, t, g, unknown or other
  misc_feature (258)..(258): n is a, c, g, or t
  modified_base (580)..(580): a, c, t, g, unknown or other
  misc_feature (580)..(580): n is a, c, g, or t
  modified_base (598)..(598): a, c, t, g, unknown or other
  misc_feature (598)..(598): n is a, c, g, or t
tcagtcacgtactacacgaccggtgctcgatttagcactcgcacgttgggtctgggagaggagccccagccctgagattcccaggtgtttccattcagtgatcagcactgaacacagagactcaccatggagttgggactgagctggtattttcctttggcttaattttaaaaggtntccagtgtgaagtgcagctggtggagtcgtgggggagtcttggtacagccgtggcgaggtccctgagcctctcctgtcgcngtccctgtggacttccactttgatgtaattacgtcgaccagtcgtacctacggtcggggtaccccgacgaaacggtccgtaacccggagggggtaacggtcccgtaggggtacgggttcggttaccgtaggtaaggtttacgtttaacggttagggtaattaggggtagttaagccgtaagtaccgggtacgtgttacgggacggtaccttgtacggggtaggaaacggtccgtaacgttcaaccgtactccgtacgagtacgaaaccgacaccgtaaagaaaccccttcgtagttactacgtagaccaaagtacgaaaccngtaccgaagaggaaccgngtacggacgtacgtacggtacgttagttattacgtacgaactaaacaaacgtaccttaaccccgttacttacgtttacggtttacggtacgttacgg

SEQ ID NO: 313611 - DNA, 654 bp, Homo sapiens
  misc_feature: GZ8MTXP02GJI17.13.55.E11.1.454.CMB.2.raw
  modified_base (350)..(350): a, c, t, g, unknown or other
  misc_feature (350)..(350): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggtcgttgggtaaagggcccggggggtcccttcgactctcctgtgcagcctctggaatctactttcgagtcgacgcgtggatgacgtggtccgcaggcctcgagggacggctggagtggtatggacgtaattaaaggngacgtctgagtgggtaggacaacgagacgtacgacgtcgccgtacccggtaggaacgggcacgtacttaccacctacttcccgtaccgaagtagtacgtagtaacgttaaccgaaaggtactaaaccgtagtttacgtttacgacggtaacctaaaagttcggaaacctacggtaccgtacggtaaacccgtcgggggacccgggtactacggtcgtaccgtagtttacttacgtcgtcgacgagacacgtacctaagaccgtcgtacctagtttactttgttttacgcgtttaccggtacggg

SEQ ID NO: 313612 - DNA, 658 bp, Homo sapiens
  misc_feature: GZ8MTXP02GDMYG.13.55.E11.1.454.CMB.2.raw
  modified_base (455)..(455): a, c, t, g, unknown or other
  misc_feature (455)..(455): n is a, c, g, or t
  modified_base (493)..(493): a, c, t, g, unknown or other
  misc_feature (493)..(493): n is a, c, g, or t
  modified_base (576)..(576): a, c, t, g, unknown or other
  misc_feature (576)..(576): n is a, c, g, or t
tcagtcacgtactacacgaccggtgctcgatttagcactcgcacgttgggtttgggagaggagccccagccttgggattcccaagtgttttcattcagtgatcaggactgaacacagagggctcaccatggagtttggctgagctggattttccttgctgctattttaaaaggtgtccagtgtgaggtgcatctggtggagtcgtgggggaggtcttgggtaaaggcccgggggttcccttcggactcctccgtgtcgcagcctgtgaatcctacttacagtgacgcctgactgacgtcggtccgcgaggcctaccggaggggaggcgtaggacgtaggagttggaccgttaagttaaaacgtgacgtccgtagtacgtggtacggaccaacgacgacgtacgctcgaccgaccgggtagacgggacagtacgtacaccgtactcctacaggtanagtcgtaactacgaaacgaacacgtagttacttacganaaccgtaaagtacgtaagacgtaccgtaggtaccgtacggaccgggtacaccggtcgaccgttagtacgtttacgcggtaacnccgtaagacgtacgaccgtacgttaccgaagtacccttaaagtttcgtttacgttttcgtaaccggtttcggtaacccgggg

SEQ ID NO: 313613 - DNA, 587 bp, Homo sapiens
  misc_feature: GZ8MTXP02GL7I2.13.55.E11.1.454.CMB.2.raw
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (321)..(321): a, c, t, g, unknown or other
  misc_feature (321)..(321): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (494)..(494): a, c, t, g, unknown or other
  misc_feature (494)..(494): n is a, c, g, or t
  modified_base (502)..(502): a, c, t, g, unknown or other
  misc_feature (502)..(502): n is a, c, g, or t
tcagtcacgtactacacgaccggtgctcgatttagcactcgcacgttgggtttgggggagctctgggagaggagccccagccctgagattcccaggtgtttccattcagtgatcagcactgaacacagaggactcaccatggagttgggactgagctggtattttcctttggcttaattttaaaaggtgtccagtgtagaagtgcagcgtggtggagtcgtgggggagtcttaggtacagccgtggctaggtccctgagactctcctgncngcctcgtgacttcgactttgatgtattatgaccatgcacgtgggtccganagctaccgaggggacggcctaggagtgggtctaccgtagtagttaggtaggaactaggngtagntaagtgggtactagngtcggtactgtaggtagacgggacctattaccgaccattcgaccagaacgaacgaaaccacgaaaactccctacctagtactcgtacactaaanacgaaacncgacagacgacgacgtagacgacgtacgtcttaacgtattacgtaagtaacaaactaaacgtacctaacccgtacgtttagttag

SEQ ID NO: 313614 - DNA, 621 bp, Homo sapiens
  misc_feature: GZ8MTXP02IH17L.13.55.E11.1.454.CMB.2.raw
  modified_base (422)..(422): a, c, t, g, unknown or other
  misc_feature (422)..(422): n is a, c, g, or t
tcagtcacgtactacacgaccggtgctcgatttagcactcgcacgttggggtttgggggagtcagtctcagtcaggacacagcatggacatgagggtccccgctcagctcctggggctcctgctactctggctccgaggtgccaaatgtgacatccagatgaccagtctccatcctcctgtctgcatctgtaggagacagagtcaccatcacttggccggcaagtcagagctaattaccaatattagaattgtactacaaacaaaacgagggagacgcccctacaccttcttaactcgttaatggtcgactaactaccctaacttaaacgaaacggtcgggtaccccatacggaaggtttcaggtggacacgtgggaactcggttaacgggctagttacttccgacttcctacgaaccctanacgatactacgtcgtactaaccctacgtaagtaatttattactaacttaaactttattacgtactaactaagtagttacgttacgacgtacggacggtacgtacggaacggaacggaacgtaaggtaacgtaaacgtaacaaacgtaacgtacgtacgtacacgacaacgtacttacgtcttactcctacgttcctccg

SEQ ID NO: 313615 - DNA, 542 bp, Homo sapiens
  misc_feature: GZ8MTXP01AZEG5.39.71.G05.1.454.CMB.2.raw
  modified_base (287)..(287): a, c, t, g, unknown or other
  misc_feature (287)..(287): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
  modified_base (483)..(483): a, c, t, g, unknown or other
  misc_feature (483)..(483): n is a, c, g, or t
  modified_base (535)..(535): a, c, t, g, unknown or other
  misc_feature (535)..(535): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagccggcttttctgtggctattttaaaggtgtccagtgtgaggtgcagctgttggagtcgtgggggaggcttggtacaggccggggggtcctgagactctcctgtgcagcctctggattcaccttcagcagctatgccatgacctgggtcccnccaggcctccgagggaaggctggagtgggtctcgtctagtagtggaagtggtgcttanacaaactcgnagcctcaatgaacgggccncttcaccatctccagagactatccaagacgcactctgtactctgacaaatgaacagcctagaggtcgccggaggacaccggccctagtattagtgtgacgaaagtgggngggggtagtgggggcttacgttcgtgggtcgtttgacgtacgttggggccgngggtccg

SEQ ID NO: 313616 - DNA, 497 bp, Homo sapiens
  misc_feature: GZ8MTXP01DZKRE.39.71.G05.1.454.CMB.2.raw
  modified_base (494)..(494): a, c, t, g, unknown or other
  misc_feature (494)..(494): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccacagggccactcggtatccagccacctttaagtgcagtgggtctggggacagagttcactctcacatcagcagcctgcagtctgaagattttgctagtttattactgtcaacagtacaatgactggcctcttcactttcggcgtaggaccgaggttgaagataacaagaacttgtggntcg

SEQ ID NO: 313617 - DNA, 502 bp, Homo sapiens
  misc_feature: GZ8MTXP01DD3V1.39.71.G05.1.454.CMB.2.raw
  modified_base (341)..(341): a, c, t, g, unknown or other
  misc_feature (341)..(341): n is a, c, g, or t
  modified_base (449)..(449): a, c, t, g, unknown or other
  misc_feature (449)..(449): n is a, c, g, or t
tcagtcgcactagtcacgaccggtgctcgatttagtgtcgtcgcaagagagagggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccacagggccactggtactcccagccctaccctttagnggcagtgggtctgggcagagttcactctcacatcagtagcctgcagtctgaagtatttgctagtttattactggtacaactagtacatgactggcctctcacttcggnggtaagggaccagggtggagatcaaaacgcttggtggctgcaccatcttgttc

SEQ ID NO: 313618 - DNA, 529 bp, Homo sapiens
  misc_feature: GZ8MTXP01DP325.39.71.G05.1.454.CMB.2.raw
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (410)..(411): a, c, t, g, unknown or other
  misc_feature (410)..(411): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
tcagtcgcactagtcacgaccggtgctcgatttagtgtcgtcgcaagagagaggggcccagccctgggatttcaggtgtttcatttggtgatcaggactgaacagagagaactcaccatggagtttgggctgagctggcttttctgtggctatttaaaggtgtccagtgtgaggtgcagctgttggagtctgggggaggcttgggtacaggccggggggtcctgagactctcctgtgcagcctctggattcaccttcagcagctatgccatgacctggtccgcaggctccagggaggactggagtgggtctcgtctattagtggaagtggtgcttataccaaactcgcagccctccgtgaacggggccncttcaccatctccaganactattccaagancactctgtatnnanaananacgacgctgagcgcgacgacgacgacctatatatgtgagagtagggttggggtagggtggggttcgttcgttcgtggtcggttcgtacgtacggttacgggtcggcggtcg

SEQ ID NO: 313619 - DNA, 508 bp, Homo sapiens
  misc_feature: GZ8MTXP01D362V.39.71.G05.1.454.CMB.2.raw
  modified_base (193)..(193): a, c, t, g, unknown or other
  misc_feature (193)..(193): n is a, c, g, or t
  modified_base (310)..(310): a, c, t, g, unknown or other
  misc_feature (310)..(310): n is a, c, g, or t
  modified_base (394)..(394): a, c, t, g, unknown or other
  misc_feature (394)..(394): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
tcagtcgcactagtcacgaccggtgctcgatttagtgtcgtcgcaagagagaggggtcaggctggaactgaggagcagggtgggggcacttctccctctaacactctccccagcgcagcttctcttcctcctgctactctggctcccagatatcactggagaaatagtgatgacgcagtctccagccaccctntctgtgtctccaggagaaagagccacctctcctgtagggccagtcagagtgttagctacaacttagcctggtaccagcaagaacctggccaggttcccaggctcatcatctatggtncactccaccgagggccacgtcggtactccagccctacctttaaggtggctagtggggtctggggacagagttcactctcattancagcagcctgcagtctagaagtntttagntagtttatactgtcagcagtatatgactggtccttagtcgcaaggggtacaagggttgaaatcaaacgtctggtggactgctaac

SEQ ID NO: 313620 - DNA, 256 bp, Homo sapiens
  misc_feature: GZ8MTXP01EQ4OY.39.71.G05.1.454.CMB.2.raw
  modified_base (253)..(256): a, c, t, g, unknown or other
  misc_feature (253)..(256): n is a, c, g, or t
tcagtcgcactagtcacgaccggtgctcgatttagtgtcgtcgcaagagagaggggagtggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnn

SEQ ID NO: 313621 - DNA, 672 bp, Homo sapiens
  misc_feature: GZ8MTXP01DSYQX.39.71.G05.1.454.CMB.2.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
tcagtcgcactagtcacgaccggtgctcgatttagtgtcgtcgcaagagagaggggcccagccctgggattttcaggtgtccagtgtgaggtgcagctgttggagtctgggggaggcttggtacaggccgggggggtccctgagactctcctgtgcagcctctggattcaccttcagcagctatgccatgacctggtccnccaggctccagggaaggctggagtggtctcgtntattagtggaagtggtntctttanacaaaactcgcagccctcgaggaacgggcctnttcaccatctccaagagactatccaagacnctactntatactctanaactaaatacgaaccncgtcgtaggacgtccggaacccggaacgaaccgtacccggtacctttaagttacttttaggtaggtacggtaaaggtaagggttgggggtagggggtagggtcgggtacttacgttcggtggtttcgttacgacggttacgggtcggggacgtacggggtccggtccggttacggtccctaccgtccgtccgtaccgtaccgtacccgtacccgaaccggtaccggtccctccggttcccggtttccccttccccggcggccctcccgtacgttcccgttccggacggccacccgtaaccgcggagacgaacccgcggcgg

SEQ ID NO: 313622 - DNA, 644 bp, Homo sapiens
  misc_feature: GZ8MTXP01A20RY.39.71.G05.1.454.CMB.2.raw
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (295)..(295): a, c, t, g, unknown or other
  misc_feature (295)..(295): n is a, c, g, or t
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtgtcgtttctaggtggctaatttaaaaggtgtccagtgtgaggtgcagctggttggagtcgtgggggaggnttggtacnggccggggggtcctgagactctcctgtgcagcctctggtattccaccttcagcagctatcgccatcgaccgtgggccncgaggcctcgaagggacggactggaggtcggtctcggtntagttaggtggagtggtntataataaccaactcgcgacgtccgtaacggacggaacgggtcctctaccacctatccacgaagtacgtacttactaccgaagacgactactacttacgtactacgtacgtaactaaacgtaacgaacgacgtacgtacgtacgtacgacgacggacgaccgtacgtacttacgttagttagtaagtaacggttaagggtaggggttagggggtaggggtacggggttacggttcggttcggttcggttcggttcggttacggtacggttacgggtcgggaacgggtaacgg

SEQ ID NO: 313623 - DNA, 580 bp, Homo sapiens
  misc_feature: GZ8MTXP01EKF5C.39.71.G05.1.454.CMB.2.raw
  modified_base (457)..(469): a, c, t, g, unknown or other
  misc_feature (457)..(469): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccaggagaaagcgccaccctctcctgtagggccagtcagagtgtagctaactaacttacgacgtacgtacgacgacgacgaacgtaccgtaccgtaccgtaccgtaccgtacgtactactactactactagtagtcgtacacgtaccccgaccgacggaccgtacgtacgtaacctacccgtaaccgtacccgtaccgttacggtacggtacgtacgggtcgggtacggtagggtacgtaggtacgtacactctnnnnnnnnnnnnnactcacgcgtacgacctcgtcgtaacgtacgttcgtacgttacgttacgttacttacgttacttacttaacttacgtaacgtaacgtacgttaactaacgttaacgtaacg

SEQ ID NO: 313624 - DNA, 522 bp, Homo sapiens
  misc_feature: GZ8MTXP01DTHB8.39.71.G05.1.454.CMB.2.raw
  modified_base (183)..(183): a, c, t, g, unknown or other
  misc_feature (183)..(183): n is a, c, g, or t
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
  modified_base (447)..(447): a, c, t, g, unknown or other
  misc_feature (447)..(447): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctntctgtgtctccaggagaaagngccaccctctcctgtagggccagtcagagtgttagctacaacttagcctggtacagcagaaacctggccaggtcccaggctcatcatctatggtncatccaccgagggccactggtactcccagccctacctttaggnggcagtgggtctgggcagagttcactctcacatcagcagcctgctagtctagaagtatttgcttagtttattacgtgtactaaacagtaacaatgactggccttntctacgtttcgggaacggagggaccgtaaggttggaagtattacgaaacgttactgtaggctgccactgttcttg

SEQ ID NO: 313625 - DNA, 534 bp, Homo sapiens
  misc_feature: GZ8MTXP01AWOCF.39.71.G05.1.454.CMB.2.raw
  modified_base (183)..(183): a, c, t, g, unknown or other
  misc_feature (183)..(183): n is a, c, g, or t
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (342)..(342): a, c, t, g, unknown or other
  misc_feature (342)..(342): n is a, c, g, or t
  modified_base (452)..(452): a, c, t, g, unknown or other
  misc_feature (452)..(452): n is a, c, g, or t
  modified_base (526)..(526): a, c, t, g, unknown or other
  misc_feature (526)..(526): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctntctgtgtctccaggagaaagngccaccctntcctgtagggccagtcagagtgttagctacaacttagcctggtaccagcagaaacctggccaggttccaggctcatcatctatggtgcatccaccagggccactggtactcccagcctaccctttaggnggcaggtggtctgggcagtagttcactctcacatcagcagcctgctagtctggaacgtatttgacttagtttattacgtgtacaactaagttacaattgactcggccctntcctacgtttcgggaacggacgggacctaagggttggaagaacttacgaaacgttaacgtgtagctacgcactnttccgttg

SEQ ID NO: 313626 - DNA, 595 bp, Homo sapiens
  misc_feature: GZ8MTXP01EGVOF.39.71.G05.1.454.CMB.2.raw
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (289)..(289): a, c, t, g, unknown or other
  misc_feature (289)..(289): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttctgtggctattttaaaaggtgtccagtgtgaggtgcagctgttggagtctgggggagcttggtacagccggggggtccctgagactctcctgtgcagcctctggattcacctnagcagctancgcagtcgaccgtcgggcccncgaggcctacgaaggggaaggtacgtgggaggtgggtctcgtacttaagttaggtaggtaagtggtacgtacttaactaacaaactcgcacgtcccttacggtggaacgggccctctaccaaccatcctacaagacgactactacaagaacgacactactagtatactacgacaaataaggaacaacgacgtagagcgacgacggacgacgtacctactattatgtagagtaagttagggtaggggtagggttgggttcgttacgtcgtcggtcggtttcgtacgttacggtcgggcggtaacggg

SEQ ID NO: 313627 - DNA, 255 bp, Homo sapiens
  misc_feature: GZ8MTXP01ETN33.39.71.G05.1.454.CMB.2.raw
  modified_base (253)..(255): a, c, t, g, unknown or other
  misc_feature (253)..(255): n is a, c, g, or t
tcagtcgcactagtcacgaccggtgctcgatttagtgtcgtcgcaagagagagggggagtggggctactcctggcgttttaactactgggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnn

SEQ ID NO: 313628 - DNA, 257 bp, Homo sapiens
  misc_feature: GZ8MTXP01EQ3RS.39.71.G05.1.454.CMB.2.raw
  modified_base (256)..(257): a, c, t, g, unknown or other
  misc_feature (256)..(257): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnn

SEQ ID NO: 313629 - DNA, 632 bp, Homo sapiens
  misc_feature: GZ8MTXP01EXD4V.39.71.G05.1.454.CMB.2.raw
  modified_base (166)..(166): a, c, t, g, unknown or other
  misc_feature (166)..(166): n is a, c, g, or t
  modified_base (183)..(183): a, c, t, g, unknown or other
  misc_feature (183)..(183): n is a, c, g, or t
  modified_base (188)..(188): a, c, t, g, unknown or other
  misc_feature (188)..(188): n is a, c, g, or t
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtgtgtttctaggtggctaatttaaaggngtcagtgtgagtgcagntgtgngtgtgggaggngtggtacgcggccgggggtccgtgagctctctgtgcncgtctcgtgtctctactcngcngctncncncgtcgtcgtcggccgcgcgcgacggaggaggagtggtggtgtcgtcgtagttagttaggtaggtaggtgtacgtacgtaacgtaactaacgtacgacgtaccgtaccgtcgtcggtacgtccgtacctacctacctactacacgtacgtacgtactaacgtacgaacgacgtactacttacgtacgtacgtacgtaacgtaacgtaacgtacggaacgtacgtacgtacggtacgacgacgacgtacgtaccgtactagttagttagtaaggtaggttaggtagggttggggtagggtacgggttacggttcgttcggttcgttcggttcggttacggtacggttacgggtccggttaacggtcgg

SEQ ID NO: 313630 - DNA, 509 bp, Homo sapiens
  misc_feature: GZ8MTXP01AKN9A.39.71.G05.1.454.CMB.2.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (494)..(494): a, c, t, g, unknown or other
  misc_feature (494)..(494): n is a, c, g, or t
  modified_base (506)..(506): a, c, t, g, unknown or other
  misc_feature (506)..(506): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagngccaccctctcctgtagggccagtcagagtgttagctacaacttagcctggtaccagcagaaacctggccaggctcccaggctcctnatctatgatgcctccaccagggccactggtactccagccaggttcagtgcagtgggtctgggacagagttcactctcattatcagcagcctgacagtctgaagtatttagcttagtttattactgtacaacgtagtaacatgtactggacccttctctacgtttcggcggttagggaccagggtagagagttcaacgaactgnggctgctaacgntcg

SEQ ID NO: 313631 - DNA, 597 bp, Homo sapiens
  misc_feature: GZ8MTXP01A50ZE.39.71.G05.1.454.CMB.2.raw
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
  modified_base (338)..(338): a, c, t, g, unknown or other
  misc_feature (338)..(338): n is a, c, g, or t
  modified_base (392)..(392): a, c, t, g, unknown or other
  misc_feature (392)..(392): n is a, c, g, or t
  modified_base (430)..(430): a, c, t, g, unknown or other
  misc_feature (430)..(430): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtggtctttttcttgtggctattttaaaaggtgtccagtgtgaggtgcagctgttggagtctgggggaggcttggtacaggccgggggggtccctgagactctcctgtgcagcctctggattcaccttcagcagctangccatcgacctgggtccncagctccgaggggaggactggagtgggtctcggtctagtttaggnggaagtggtgactttaactaacaaaactcgcacgccctccggtgaacggggccncttcaccatctccagagactactaccaagacgacactntacgtatctagacaaactggaacagcctgagtcgccggaggaaccgaccggtaccctaattacttaagttggtgacggtaaagttggggtaggggggtaggttcgggggttcttaccggtccggttgggtcggttttcggcgttacggtcgggggcccggtaagggg

SEQ ID NO: 313632 - DNA, 547 bp, Homo sapiens
  misc_feature: GZ8MTXP01DTC5P.39.71.G05.1.454.CMB.2.raw
  modified_base (183)..(183): a, c, t, g, unknown or other
  misc_feature (183)..(183): n is a, c, g, or t
  modified_base (213)..(213): a, c, t, g, unknown or other
  misc_feature (213)..(213): n is a, c, g, or t
  modified_base (344)..(344): a, c, t, g, unknown or other
  misc_feature (344)..(344): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctntctgtgtctccaggagaaagagccaccctntcctgtagggccagtcagagtgttagctaacaacttagcctggtaccagcagaaacctggccaggttcccaggctcatcatctatggtgcatccaccagggccacgtggtactcccagcctaccctttagngcagtgggtctgggcagtagttcactctcaccatcagcacgctgcagtctagaagtatttgtactttattactggtactagtactagttatgtactaccgtacggtcctctactacgttttcgggccgtaggggaccgtagggttgggaagtacgttacgaaacgttaaccgtggtggtcgtggtcacctaacgttcgttccg

SEQ ID NO: 313633 - DNA, 548 bp, Homo sapiens
  misc_feature: GZ8MTXP01CBDHA.39.71.G05.1.454.CMB.2.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (310)..(310): a, c, t, g, unknown or other
  misc_feature (310)..(310): n is a, c, g, or t
  modified_base (356)..(356): a, c, t, g, unknown or other
  misc_feature (356)..(356): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccagganaaagngccaccctntcctgtagggccagtcagagtgttagctacaattagcctggtaccagcagaaacctggccaggttcccaggctcatcatctatggtncatccaccagggccacgtcggtactccgagtccctaccgtttaagnggcagggttgggtctggggacaggtacgtttccgacttctaccacatcagcacgcctgcagtctagaacgtattttgacttagtttattacgtcgtacaactagtactaatgactggccttcttctacgtttcgggcggacgggaccgagggttcggaaggataacgaaacgtacgttggtaacgcgtaacg

SEQ ID NO: 313634 - DNA, 742 bp, Homo sapiens
  misc_feature: GZ8MTXP01DQJO6.39.71.G05.1.454.CMB.2.raw
  modified_base (445)..(445): a, c, t, g, unknown or other
  misc_feature (445)..(445): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggcttaattttaaaaggtgtccagtgtgaggtgcagctggttggagtcgtggggggaggcttggtacagggcccggggggtccctgagactctcctgtgcagcctcgtggattccaccttcagcagctatgccatcgaccgtgggtcccgcaggctccgaggggaaggactgggagtgggtctcgtctagttagtggaagttggtgacttataaccaaaactcgcagcccgtacgtggaacggggccctcgttccaaccctatcctaccgagacgtacttatacccaaagacnctaactctagtaacttcgagaacctaaaattacggaaaccacggtcccgttagggaacggttacggaccccggaacgggaacccgtaaacccggggtacccctttaaagtttaacgttttaacgtttgggtaacggtaaccgggttaaaaagggtttcggggggttacggggggggggtaaagggttccgggggggggttaccctttaaccggtttccccgggttgggggttacccgttttttggaacccggtttaacgggttcggggggtaacccgttaaggggggtaaccccggg

SEQ ID NO: 313635 - DNA, 546 bp, Homo sapiens
  misc_feature: GZ8MTXP01BULVX.39.71.G05.1.454.CMB.2.raw
  modified_base (371)..(371): a, c, t, g, unknown or other
  misc_feature (371)..(371): n is a, c, g, or t
  modified_base (537)..(537): a, c, t, g, unknown or other
  misc_feature (537)..(537): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccgggggggtccctggagactctcctgtgcagcctctggattcaccttcagcagctatgccatgacctggtccgccaggctccgagggaggactggagtggtctcgtctagttagtggaagtggtgcttataccaaactacgcagcctaccggngaacgggccgcttcaccatctccagagactattccaagacgcactctgtatctgacaaatgaacagcctagagtcgccgaggacacggccctatacttatgtgacgttaaagtggttgggggagtgggggcttcgttcgtggtcgtttgctacggttcgggtccgngggtaaccg

SEQ ID NO: 313636 - DNA, 257 bp, Homo sapiens
  misc_feature: GZ8MTXP01EEEH6.39.71.G05.1.454.CMB.2.raw
  modified_base (254)..(257): a, c, t, g, unknown or other
  misc_feature (254)..(257): n is a, c, g, or t
tcagtcgcactagtcacgaccggtgctcgatttagtgtcgtcgcaagagagagggggagtggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnn

SEQ ID NO: 313637 - DNA, 256 bp, Homo sapiens
  misc_feature: GZ8MTXP01AZA6L.39.71.G05.1.454.CMB.2.raw
  modified_base (248)..(248): a, c, t, g, unknown or other
  misc_feature (248)..(248): n is a, c, g, or t
  modified_base (254)..(256): a, c, t, g, unknown or other
  misc_feature (254)..(256): n is a, c, g, or t
tcagtcgcactagtcacgaccggtgctcgatttagtgtcgtcgcaagagagagggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcggctggcaaggcncatagnnn

SEQ ID NO: 313638 - DNA, 570 bp, Homo sapiens
  misc_feature: GZ8MTXP01DTGJ8.39.71.G05.1.454.CMB.2.raw
  modified_base (166)..(166): a, c, t, g, unknown or other
  misc_feature (166)..(166): n is a, c, g, or t
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
  modified_base (256)..(260): a, c, t, g, unknown or other
  misc_feature (256)..(260): n is a, c, g, or t
  modified_base (262)..(263): a, c, t, g, unknown or other
  misc_feature (262)..(263): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtgtgtttctaggtggctattttaaaggngtcagtgtgaggtgcagctgttggagtntggggaggcttggtacngcggggggtccctgagctctcctgtgcagctctgatcacttcagnnnnncnngcgcgcgcgngcgcgaggagngnggngtgtgtcgtgtagtagtagtagtgtgtactactactaacgtacgacacgtacgtcgtcggacggccgtctcactactctcagagtactactacaagacgactactctactactactactaactaactaacggaacgacgtacgtacgacgtacggacggacggaaccgaccgtacctagttattagttaagtagttaggtaaggttagggtagggggtggggttcgggttcgttcgttcggtcggttcggttcggtacggttacggtcgggcggtaacggg

SEQ ID NO: 313639 - DNA, 588 bp, Homo sapiens
  misc_feature: GZ8MTXP01ATYD9.39.71.G05.1.454.CMB.2.raw
  modified_base (190)..(190): a, c, t, g, unknown or other
  misc_feature (190)..(190): n is a, c, g, or t
  modified_base (211)..(211): a, c, t, g, unknown or other
  misc_feature (211)..(211): n is a, c, g, or t
  modified_base (269)..(269): a, c, t, g, unknown or other
  misc_feature (269)..(269): n is a, c, g, or t
  modified_base (309)..(309): a, c, t, g, unknown or other
  misc_feature (309)..(309): n is a, c, g, or t
  modified_base (334)..(334): a, c, t, g, unknown or other
  misc_feature (334)..(334): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctccagatatcactggagaaatgtgatgacgcagtctccagccacctntctgtgtctccaggagaaagngccacctctcctgtacgggccagtcagagtgttagctacaacttgcctaggtaccaanacgaaacctggccaggttccaggctcatcatctagtggtncatccacgagggccacgtggtaccncccgagtaccctacgtttaggtcggcctaagggtcgggtctaggggaactaggtacgttcactctcacatcagcacgcctgcagtctagtaagttatttcgggtacttaagttttacttacgttgtaacctaaactagttaacaagttcgtacgtcggtacctctacgttacggtttcgggacgggtacgggaaccgttagggttggaacgtaacgttaaccgaaacgtccggtggttacggtcttcgaacccg

SEQ ID NO: 313640 - DNA, 592 bp, Homo sapiens
  misc_feature: GZ8MTXP01AJEC5.39.71.G05.1.454.CMB.2.raw
  modified_base (168)..(168): a, c, t, g, unknown or other
  misc_feature (168)..(168): n is a, c, g, or t
  modified_base (257)..(263): a, c, t, g, unknown or other
  misc_feature (257)..(263): n is a, c, g, or t
  modified_base (266)..(266): a, c, t, g, unknown or other
  misc_feature (266)..(266): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (420)..(420): a, c, t, g, unknown or other
  misc_feature (420)..(420): n is a, c, g, or t
  modified_base (434)..(434): a, c, t, g, unknown or other
  misc_feature (434)..(434): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtgcgttttctaggtggctattttaaaaggngtccagtgtgaggtgcagctgttggagtctgggggagcttggtacagccgggggggtcctgagctctcctgtgcagctctgatcactcnnnnnnncangcgcggcgcgcgcgcgaggaggacgnggngtggtcgtcgtgtagttagtaggtagtggtgtactactaactaacgtacgacgacgaccgtccggtcggacgggccgtactaccaccactctaccacgacgtactactacaacgacgacactctntactctacactaanacggaacacgcgacgacgcgacggacggacgaccgtaccgtacgttacttagttgtagttacgtaaggttaggggtagggggtaggggttcggggttcggttacgttcggttcggttcggtttacggttacggttacgggtcgggaacgggtaacggg

SEQ ID NO: 313641 - DNA, 561 bp, Homo sapiens
  misc_feature: GZ8MTXP01ER73W.39.71.G05.1.454.CMB.2.raw
  modified_base (414)..(414): a, c, t, g, unknown or other
  misc_feature (414)..(414): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (557)..(557): a, c, t, g, unknown or other
  misc_feature (557)..(557): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtggtcttttctgtggctattttaaaaggtgtccagtgtgaggtgcagctgttggagtcgtgggggaggcttggtacaggccgggggggtccctgagactctcctgtgcagcctctggattcaccttcagcagactatcgccatcgaccgtgggtcccgccaggctccgagggagggactgggagtgggtctcgtctattaggtggaggttggtgacttataacccaaactacgcacgccctaccggtgaacgggcctcttcacctatctccaaganaactattacaagacgacactctgtatctanacaaanacgaacgacgcgtagacgcgacgacgaccgacgtacctatattgtgtgagaggtgggttggggtaggtgggttcgttcgttcgtggtcgttcgcgtcggcgggtcgnggcg

SEQ ID NO: 313642 - DNA, 652 bp, Homo sapiens
  misc_feature: GZ8MTXP01CVLRR.39.71.G05.1.454.CMB.2.raw
  modified_base (334)..(334): a, c, t, g, unknown or other
  misc_feature (334)..(334): n is a, c, g, or t
  modified_base (379)..(379): a, c, t, g, unknown or other
  misc_feature (379)..(379): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccgggggggtcctgagactctcctgtgcagcctctggattcaccttcagcagctatgccatgacctgggtccgccaggctccgaggggagggctggagtgggtctcgtctagttagnggagtgtgcttataccaaactcgcagccctaccgtgaacgggccncttcaccatcctcagagactatccaagacgcactctgtactctgacaaatcgaaacgacgtccgttaggaacggtcgacccggaagggacccgtaaccgggtaccccttaaagttaacgttttacgttagggtggtaaccgggttaaaaggttcggggggttaggggggtaagggttcggggggttacctttaccggttccggtttcggggttcggtttttaacggaacccggtttcgggttaccgggggtcccggaagggggtaaccccggg

SEQ ID NO: 313643 - DNA, 522 bp, Homo sapiens
  misc_feature: GZ8MTXP01AYCAO.39.71.G05.1.454.CMB.2.raw
  modified_base (194)..(194): a, c, t, g, unknown or other
  misc_feature (194)..(194): n is a, c, g, or t
  modified_base (215)..(215): a, c, t, g, unknown or other
  misc_feature (215)..(215): n is a, c, g, or t
  modified_base (262)..(262): a, c, t, g, unknown or other
  misc_feature (262)..(262): n is a, c, g, or t
  modified_base (408)..(408): a, c, t, g, unknown or other
  misc_feature (408)..(408): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagcccaccctntctgtgtctccaggagaaagngccacctctcctgtagggccagtcagagtgttagctacaactagccnggtaccagcagaaacctggccaggttcccaggctcatcatctatggtgcatccaaccaggggcccacgtcggtactccgagccctacctttaaggtgcagtgggtctggggacagagttcactctcacatcagcagcctgcagtcngaagtatttgctagtttatactgtcaacagtactaatgactggcctgttctacgtttcggacggtagggaccgaagggttggaagtataacgaaacgtacgttgtcgaacgtcg

SEQ ID NO: 313644 - DNA, 530 bp, Homo sapiens
  misc_feature: GZ8MTXP01A4HXG.39.71.G05.1.454.CMB.2.raw
  modified_base (193)..(193): a, c, t, g, unknown or other
  misc_feature (193)..(193): n is a, c, g, or t
  modified_base (214)..(214): a, c, t, g, unknown or other
  misc_feature (214)..(214): n is a, c, g, or t
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
  modified_base (413)..(413): a, c, t, g, unknown or other
  misc_feature (413)..(413): n is a, c, g, or t
  modified_base (494)..(494): a, c, t, g, unknown or other
  misc_feature (494)..(494): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctntctgtgtctccaggagaaagngccacctctcctgtagggccagtcagagtgttagctacaacttagcctggtaccagcaagaaacctggccaggttcccaggctcatcatctatggtncatccacaggccactcggtactccagccctacgtttaagnggcaggtgggtctggggacaggtagttcactctacacatcagcagcctgcagtctagaagtntttgcttaagtttattactgtacaaactagtactaatgactggccttcttcgtacgttcgggacgggaagggaccgaaggngtaagagtaactaaacgaacgttacgtggcgtaacg

SEQ ID NO: 313645 - DNA, 570 bp, Homo sapiens
  misc_feature: GZ8MTXP01DFIDV.39.71.G05.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (302)..(302): a, c, t, g, unknown or other
  misc_feature (302)..(302): n is a, c, g, or t
  modified_base (408)..(408): a, c, t, g, unknown or other
  misc_feature (408)..(408): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagngccaccctntcctgtagggccagtcagagtgttagctaacaacttagcctggtaccagcagaaacctggccacggttcccaggctcatcatctatggncatcccacgagggcccacgtggtactcccgagccctaccgtttaggcggctaggtgggtcgtgggcagtgttcactctacacatcagcagcctgcagtcagaagtnttagcttaagtttacttacgtgtcaagtctaagttaataagtgtaacttcggtaccttacggttccgggaccgaaaggggtccgaaagggttacgaaaacgttacgaaaacgttaacgttggttacggaactagcctaacctagttcttcgttcgtttaacc

SEQ ID NO: 313646 - DNA, 727 bp, Homo sapiens
  misc_feature: GZ8MTXP01A0J1V.39.71.G05.1.454.CMB.2.raw
  modified_base (301)..(301): a, c, t, g, unknown or other
  misc_feature (301)..(301): n is a, c, g, or t
  modified_base (349)..(349): a, c, t, g, unknown or other
  misc_feature (349)..(349): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagcgccaccctctcctgtagggccagtcagagtgttagctaacaacttagcctggtaccagcaagaacctggccaggtcccaggctcatcatctatggtncatcccacgagggcccacgtggtactcccagtccctacccgtttaggnggctagggtcgggtactggggaactagggtacgtttccaccttcctaccgaaccctataccgaacgccgaacgtcccgtaggaccgtaacggttccgtaggtaaagttagtttttcggactttaaggtttttaactttaacgggttacggttaaaccgtaaacctaaggttaaacctaaacgttacggtaaccgttcgggtaccccttaccgtttacccgttaacccgggttttccgggggaaccgggggtaaaccgggggttaaacccggtaaagggggttagggaaacggtaacgttaaaccgggaaaacggttaaccggttgggtaccggggtaaccttacgggacccgttaacctaacgtttccgtttaaccgg

SEQ ID NO: 313647 - DNA, 535 bp, Homo sapiens
  misc_feature: GZ8MTXP01EU1SV.39.71.G05.1.454.CMB.2.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccagganaaagngccaccctctcctgtagggccagtcagagtgttagctacaacttagcctggtaccagcaagaaacctggccaggttcccaggctcatcatctatggtgcatccaccgagggccacgtcggtactccagccctaccgtttaagcggcaggtgggtctggggacaggattcactctcacatcagcagcctgcngtctagaagtntttgactagtttatactgacaacagtactaagtcgactcggccttcttcgtacgtttcgggcgggtaacgggaccgaaggggttgaaggtataacgaaacgtagttggtaacgcgtaag

SEQ ID NO: 313648 - DNA, 257 bp, Homo sapiens
  misc_feature: GZ8MTXP01BI5XD.39.71.G05.1.454.CMB.2.raw
  modified_base (253)..(257): a, c, t, g, unknown or other
  misc_feature (253)..(257): n is a, c, g, or t
tcagtcgcactagtcacgaccggtgctcgatttagtgtcgtcgcaagagagagggggagtggggctactcctggcgtttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnnn

SEQ ID NO: 313649 - DNA, 520 bp, Homo sapiens
  misc_feature: GZ8MTXP01BLQET.39.71.G05.1.454.CMB.2.raw
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
  modified_base (454)..(454): a, c, t, g, unknown or other
  misc_feature (454)..(454): n is a, c, g, or t
tcagtcgcactagtcacgaccggtgctcgatttagtgtcgtcgcaagagagaggggtcaggctggaactgaggagcaggtgggggcacttctccctctaacactctccccagcgcagcttctcttcctcctgctactctggctcccagatatcactggagaaatagtgatgacgcagtctccagccaccctntctgtgtctcagganaaagngccacctntcctgtagggccagtcagagtgttagctacaacttagcctggtaccagcaagaacctggccaggttcccaggctcatcatctatggtgcatccaccgagggcccagtcggtactccagccctactttaagcggcaggtgggtctggggacagagttcatctcacatcagcagtcctgcagtctagtaagtattttgctagtttatactgtacaatagtactaatgactggcctnttctaacgtttcgggacgtagggaccgagggttcggaatactaacgaaacggacttggtgcgtaag

SEQ ID NO: 313650 - DNA, 630 bp, Homo sapiens
  misc_feature: GZ8MTXP01CO49J.39.71.G05.1.454.CMB.2.raw
  modified_base (276)..(276): a, c, t, g, unknown or other
  misc_feature (276)..(276): n is a, c, g, or t
  modified_base (349)..(349): a, c, t, g, unknown or other
  misc_feature (349)..(349): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccgggggggtccctggagactctcctgtgcagcctctggacttcaccttcagcagctangccatgacctgggtccgccaggctccgaggggaaggactgggagtgggtctcgtctattaggtggaagtggtntcttactacaaactcgcacgcccttcgtggaacgggccgtcttccgaccactcctaccagacgactacttaccaagacgcactctgtatctgacaaatcggaaacacgccgtagaacgtcggacccggacggaaaccgaccgggtaccccttaagttacttagtttaacggtgaccgggtaaagttgggggtaggggggtaggggttcggggggttcttaccggttccggttcggggtcgtttttcgggacgtttacgggtcgggggccggtaaccggggg

SEQ ID NO: 313651 - DNA, 597 bp, Homo sapiens
  misc_feature: GZ8MTXP01AGDES.39.71.G05.1.454.CMB.2.raw
  modified_base (205)..(205): a, c, t, g, unknown or other
  misc_feature (205)..(205): n is a, c, g, or t
  modified_base (347)..(347): a, c, t, g, unknown or other
  misc_feature (347)..(347): n is a, c, g, or t
  modified_base (421)..(421): a, c, t, g, unknown or other
  misc_feature (421)..(421): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagcccaccctctctgtgtctccaggagaaagngccaccctctcctgtagggccagtcagagtgttagctaacaacttagcctggtaccagcagaaacctggcctaggttcccggctcatcatctatggtgcactccaccgaggccacgtggtactcccagccctacgtttacgnggcgaggtcgggtctaggggacaaggtacgttcactcctacacatcagcacgcctgcaggtctagtaaagtttntttcgactttaagtttacttacgtaggtaacaacgtagtaacagtgtacgtcgtcctcgtccgtaccggttcgggacgggtaacgggtaaccggttaagggtacggaacgtaacgtaaccgaaaacggttcggttcggtcggtacgtcggtacccgtacgttcgttcgttcgttcc

SEQ ID NO: 313652 - DNA, 259 bp, Homo sapiens
  misc_feature: GZ8MTXP01A3XC1.39.71.G05.1.454.CMB.2.raw
  modified_base (256)..(259): a, c, t, g, unknown or other
  misc_feature (256)..(259): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnn

SEQ ID NO: 313653 - DNA, 560 bp, Homo sapiens
  misc_feature: GZ8MTXP01CVEQC.39.71.G05.1.454.CMB.2.raw
  modified_base (506)..(506): a, c, t, g, unknown or other
  misc_feature (506)..(506): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggaggcttggtacaggccgggggggtccctgagactctcctgtgcagcctctggattcaccttcagcagctatgccatcgacctgggtcccgccaggcctcccgaggggaacgggactgggagtgggtctcgtctatagtggaagtggtgcttaacacaaactcgcagccctccggtgaaacgggccgcttcaccatctcccagagactattccaagagcactctgtatctgacaaatcggaacagcctagagtcgccgaggaccacggtaccctatacttatgtgacgtaaagttgggtgggggnggttgggggcttacgtccgtggtcgtttgacgttacggtcgggttcgaacgggg

SEQ ID NO: 313654 - DNA, 663 bp, Homo sapiens
  misc_feature: GZ8MTXP01DO14U.39.71.G05.1.454.CMB.2.raw
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagacgccaccctctcctgtacgggccagtcagagtgtagcagcaaacttagcctggtaccagcaagaaacctggccaggttcccaggctcatcatctagtggtcgcactccaccgagggccagtcggtactccccgagtcccccctaccgtttaggtcggcgtagggtgggggttcctggggggaacctaagggtacggttttccaaccttcctaccaaacccctatccgaacggcaacgtcccgttaggaccctaaggttctaggtaaagttattttcgactttaagttttatttaccgtgttaaccaaactagtaaccaaagttcgaactcggtcccttacgttaccgtcgtttaacgggggaccgggttaacgggaaacccgttaaaggggttacggaagttaacgttaaccgaaaacggtaacttggtcggctacggacctaacccgttaatttcccg

SEQ ID NO: 313655 - DNA, 566 bp, Homo sapiens
  misc_feature: GZ8MTXP01DOFVN.39.71.G05.1.454.CMB.2.raw
  modified_base (214)..(214): a, c, t, g, unknown or other
  misc_feature (214)..(214): n is a, c, g, or t
  modified_base (310)..(310): a, c, t, g, unknown or other
  misc_feature (310)..(310): n is a, c, g, or t
  modified_base (344)..(344): a, c, t, g, unknown or other
  misc_feature (344)..(344): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccaggagaaagngccacctctcctgtagggccagtcagagtgttagctacaacttagcctggtaccagcaagaaacctggccaggtcccaggctcatcatctatggtncatccacaggccactcgactccagcctacttagngctagtgggtctgggacaggtcgttcactctacacatcagcacgctgacagtctagtaaacgttgttttacgacttaagttttacttacgttgtacctaaactaagtaactaatacgtacttgggtcccttacttccgtaacgtttcggggacgggtacggggaaacccgagggttacgggaagtaacgttaacgaaaacggacgttagggtcggctaacgg

SEQ ID NO: 313656 - DNA, 634 bp, Homo sapiens
  misc_feature: GZ8MTXP01D1ACT.39.71.G05.1.454.CMB.2.raw
  modified_base (194)..(194): a, c, t, g, unknown or other
  misc_feature (194)..(194): n is a, c, g, or t
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
  modified_base (310)..(310): a, c, t, g, unknown or other
  misc_feature (310)..(310): n is a, c, g, or t
tcagtcgcactagtcacgaccggtgctcgatttagtgtcgtcgcaagagagagggggtcaggctggaactgaggagcagggtgggggcacttctccctctaacactctccccagcgcagcttctcttcctcctgctactctggctcccagatatcactggagaaatagtgatgacgcagtctccagccaccctntctgtgtctcaggagaaagngccacctctcctgtagggccagtcagngtgtagctacaacttagcctggtaccagcaagaaacctggccaggttcccaggctcatcatctatggtncactccaccgagggccacgtcggtactccagccctaccgttttaagcggtcgagggttcgggtctaggggacctaggtagtttaccacttctaccaccatcaagcagtcctgctagtctagtaagttagttttgtacgtttagttttaacttacgttcgtacctaaactaagtaacctaaagttacgtaacgttccgggtccctttcgtttacccgtaaaccgggttttccgggaacgggggtaacggggttaaacccgttaaagggggttaccggaaggtaattaaccggaaaacggtacgttaggttaacgggcttaaccgg

SEQ ID NO: 313657 - DNA, 537 bp, Homo sapiens
  misc_feature: GZ8MTXP01AL3Q2.39.71.G05.1.454.CMB.2.raw
  modified_base (223)..(223): a, c, t, g, unknown or other
  misc_feature (223)..(223): n is a, c, g, or t
  modified_base (294)..(294): a, c, t, g, unknown or other
  misc_feature (294)..(294): n is a, c, g, or t
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (467)..(467): a, c, t, g, unknown or other
  misc_feature (467)..(467): n is a, c, g, or t
  modified_base (497)..(497): a, c, t, g, unknown or other
  misc_feature (497)..(497): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccaggagaaagcgccaccctntcctgtagggccagtcagagtgttagctacaacttagcctggtaccagcagaaacctggccaggtcccggntcatcatctagtggtgcatccacgagggccacgtggtacncccagccctacctttagnggcnggtgggtctgggacagngttcactctcacatcagcagcctgctagtccgtagtaaagttgttttggacttagttttaacttacgtgtacaacagtacaatgactcggcctntcttacgttcgggcggtaacggaccagggnggagaacttacgaaacggtatggttacggtcttcggaacc

SEQ ID NO: 313658 - DNA, 596 bp, Homo sapiens
  misc_feature: GZ8MTXP01E0YK9.39.71.G05.1.454.CMB.2.raw
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (362)..(362): a, c, t, g, unknown or other
  misc_feature (362)..(362): n is a, c, g, or t
  modified_base (392)..(392): a, c, t, g, unknown or other
  misc_feature (392)..(392): n is a, c, g, or t
  modified_base (463)..(463): a, c, t, g, unknown or other
  misc_feature (463)..(463): n is a, c, g, or t
  modified_base (501)..(501): a, c, t, g, unknown or other
  misc_feature (501)..(501): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttctgtggctattttaaaaggtgtccagtgtgaggtgcagctgttggagtcgtggggggaggcttggtacgaggccgggggggtccctgagactctcctgtgcagcctctggattcaccttnagcagctangccatcgaccgtgggcccnccgagcctccgaggggaacggcgtgggaggtggtctcgtctagttggtaggaagtggtgtacttaanacaaactcgcagccctcggtgaacgggccncttccactactctaccgagacgtactactaccaagcgacctactctagtatctagactaaagtcggaaacngacctggagtcgaccgaggaccacggtccttaatattnttggagacggtaaagttggggtaggggggtacggttcgggggcttacggttccgtggttcggttttcggacgttacgggtcggggccgaacgggg

SEQ ID NO: 313659 - DNA, 589 bp, Homo sapiens
  misc_feature: GZ8MTXP01DRVWB.39.71.G05.1.454.CMB.2.raw
  modified_base (324)..(324): a, c, t, g, unknown or other
  misc_feature (324)..(324): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccgggggggtcctgagactctcctgtgcagcctctggattcaccttcagcagctatgccatcgacctgggtccgcaggctccgagggaggctggagtgggtctcgtntagttaggtggaagtggtgcttaataaccaaactacgcacgtcccgtaccgtggaacgggccgtcttacaccatctaccagacgacttataccaagtacgcacttctagtactctagactaaatcgaaacgacgtcctaggaacgtcgacccgaggaccgaaccggtacccttatattattggtgacgttaaaggtgggttgggggaggtgggggcttcgttccgtgggttcgtttggacgtacggcggggtccgaagggtcccg

SEQ ID NO: 313660 - DNA, 257 bp, Homo sapiens
  misc_feature: GZ8MTXP01CAM5D.39.71.G05.1.454.CMB.2.raw
  modified_base (247)..(247): a, c, t, g, unknown or other
  misc_feature (247)..(247): n is a, c, g, or t
  modified_base (253)..(257): a, c, t, g, unknown or other
  misc_feature (253)..(257): n is a, c, g, or t
tcagtcgcactagtcacgaccggtgctcgatttagtgtcgtcgcaagagagagggggagtggggctactcctggcgttttaactactggggccagggagccctggtcaccgtctcctcagcctccaccaagggcccatcggtcttcccctggcgccctgctccaggagcacctccgagagcacagcggcctgggctgcctggtcaaggactacttccatagtgcgactgagcgggctggacaaggcncatagnnnnn

SEQ ID NO: 313661 - DNA, 581 bp, Homo sapiens
  misc_feature: GZ8MTXP01BN3RR.39.71.G05.1.454.CMB.2.raw
  modified_base (193)..(193): a, c, t, g, unknown or other
  misc_feature (193)..(193): n is a, c, g, or t
  modified_base (214)..(214): a, c, t, g, unknown or other
  misc_feature (214)..(214): n is a, c, g, or t
  modified_base (263)..(263): a, c, t, g, unknown or other
  misc_feature (263)..(263): n is a, c, g, or t
  modified_base (355)..(355): a, c, t, g, unknown or other
  misc_feature (355)..(355): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctntctgtgtctccaggagaaagngccaccctctcctgtagggccagtcagagtgttagctacaacttagccnggtaccagcaagaaacctggccaggttcccaggctcatcatctagtggtgcactccaccgagggccactcggtactccagccctactttagnggcaggtcgggtctggggacaggagttcactctcaccatcagcagcctgcgagtctagtaagtagttttgacttaagtttattaccgtgtactaaacgtaagtaactaagttcgtaactcgggtcccttcttaccgtacgtttccgggacgggtaacgggaccgttaagggttaggaacgtaagttaaccgaaaacggtaacgttcgggtaacggttcgtaaccgg

SEQ ID NO: 313662 - DNA, 599 bp, Homo sapiens
  misc_feature: GZ8MTXP01EMYW9.39.71.G05.1.454.CMB.2.raw
  modified_base (194)..(194): a, c, t, g, unknown or other
  misc_feature (194)..(194): n is a, c, g, or t
  modified_base (215)..(215): a, c, t, g, unknown or other
  misc_feature (215)..(215): n is a, c, g, or t
  modified_base (316)..(316): a, c, t, g, unknown or other
  misc_feature (316)..(316): n is a, c, g, or t
tcagtcgcactagtcacgaccggtgctcgatttagtgtcgtcgcaagagagagggggtcaggctggaactgaggagcagggtgggggcacttctccctctaacactctccccagcgcagcttctcttcctcctgctactctggctccagatatcactggaagaaatagtgatgacgcagtctccagccaccctntctgtgtctcaggagaaagcnccacctctcctggtacgggccagtcaggagttgtagctaacaacttagctggtaccagcaagaacctggacctaggttcccaggctcatcatctatggtcncactccgaccgaggggcccacgttcggtacctccgagtccctaccgttttaaggcggcgtagggttcggggtctaggggaactagggtactttacaccttctaccaccatcagcagtcctagctagtctagtaagttagttttgactttaagttttactactcgtacctaaatacgtaactaagtcgtacgtcggtaaccttcttaccgtacggtttcgggacgggtaacgggaacgaggggttacggaagtataaccgaaagtacgttggtaacggctaacg

SEQ ID NO: 313663 - DNA, 718 bp, Homo sapiens
  misc_feature: GZ8MTXP01CN4DO.39.71.G05.1.454.CMB.2.raw
  modified_base (276)..(276): a, c, t, g, unknown or other
  misc_feature (276)..(276): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctaattttaaaaggtgtccagtgtgaggtgcagctgttggagtcgtgggggagcttggtacgagggccggggggtccctgagactctcctgtgcagcctctggattccaccttcagcagctangccatcgaccgtgggtcccgccgaggcctccgaggggaacggacgtgggagtgggtctcgtctagttaggnggagtggtntcttaacacaaactcgcacgcccttcggngaacgggccncttccaccatccnccagacgactattaccaagacgtactacgtctgttaactcgtacgaactaaagttacggaaacgtacggtacccgttaggaacggttccggacccggaacgggaacccgtacccggggtacccctttaagttaagttttaacggttcgggtaacgggttaacgggtaaaacgggtttcggggggttaacggggggggtaggggttaccgggggggttccttaacccggggtttccggttacgggggtttccggtttttaccgggaaccggtttaccggggtccgggggttaaccccgggtaaccgggggg

SEQ ID NO: 313664 - DNA, 620 bp, Homo sapiens
  misc_feature: GZ8MTXP01BADVI.39.71.G05.1.454.CMB.2.raw
tcagtcgcactagtcacgaccggtgctcgatttagtgtcgtcgcaagagagaggggggtcaggctggaactgaggagcagggtgggggcacttctccctctaacactctccccagcgcagcttctcttcctcctgctactctggctcccagatatcactggaagaaatagtgatgacgcagtctccagcccaccctctctgtgtctccaggagaaagcgcccacctctccgtgtacgggccagtcagagtgtagctacaacttagcctggtaccagcaagaaacctggccaggttcccaggctcatcatctagtggtcgactatcccaaccgacggggcccaacgtcggtactccgagtccctacgttttaaggcgcgtaggtggggtcgtaggggacaggtacgttcacttctcaccatccgagcagtcctgactagtctagtaagttgttttgactttaagtttacttacgtgtaaccaaacgtaagttaacaagtcgtacgtcggtcccttcttaccgtacggtttccggggacgggtaacggggttaaccggttaaaggggttacgggaaacgtaacgttaacgaaaacggtacgttacgggtcgttcgtaaccgg

SEQ ID NO: 313665 - DNA, 547 bp, Homo sapiens
  misc_feature: GZ8MTXP01EHOWJ.39.71.G05.1.454.CMB.2.raw
  modified_base (273)..(273): a, c, t, g, unknown or other
  misc_feature (273)..(273): n is a, c, g, or t
  modified_base (351)..(351): a, c, t, g, unknown or other
  misc_feature (351)..(351): n is a, c, g, or t
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtggtcttttctgtggctattttaaaaggtgtccagtgtgaggtgcagctgttggagtcgtgggggagcttggtacaggccgggggggtccctgagactctcctgtgcagcctctggattcaccttcagcagctangccatgacctgggtccgccaggctccgaggggaaggactggagtgggtctcggtctattaggtgaagtggtgcttaanacaaactcgcagccctcgtgaagggccgcttcaccatctccaganactatccaagngactatctgtatctaganaataggaacagcctgagngcgacgacgacgtcctatatattgtgagtaagttaggtgggggtagggttaggggttcgttacgtcgtcggtcgtttgtacgttacgtcgggttcggtaacggg

SEQ ID NO: 313666 - DNA, 575 bp, Homo sapiens
  misc_feature: GZ8MTXP01ADDJF.39.71.G05.1.454.CMB.2.raw
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
  modified_base (311)..(311): a, c, t, g, unknown or other
  misc_feature (311)..(311): n is a, c, g, or t
  modified_base (561)..(561): a, c, t, g, unknown or other
  misc_feature (561)..(561): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggaagaaatagtgatgacgcagtctccagcccaccctntctgtgtctccaggagaaagngcccaccctctcctgtagggccagtcagagtgtagctacaacttgcctggtaccagcagaacctggccaggttcccaggctcatcatctatggtncactccacgagggccacgtcggtactccagccctaccgtttaagcggcagggtgggtctaggggaccaggtacgtttcacctctaccaaccataccgagccagccctggacacgttcgtagaagttagttttgactttagtttacttacgtgtacataagtactaagtcgaacgttcggcctcttccgtaacggtttccgggacgggtaaggttacccgaagggttcgggaatactaacgaaaaccggtnttaggtcggcgtcg

SEQ ID NO: 313667 - DNA, 564 bp, Homo sapiens
  misc_feature: GZ8MTXP01C1AL1.39.71.G05.1.454.CMB.2.raw
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
  modified_base (512)..(512): a, c, t, g, unknown or other
  misc_feature (512)..(512): n is a, c, g, or t
tcagtcgcactagtcacgaccggtgctcgatttagtgtcgtcgcaagagagaggagcccagccctgggatttcaggtgttttcatttggtgatcaggactgaacagagagaactcaccatggagtttgggctgagctggctttttcttgtggctattttaaaaggtgtccagtgtgaggtgcagctgttggagtcgtggggggaggcttgggtacagggccgggggggtccctgagactctcctgtgcagcctctggattcaccttnagcagctatgccatgacctgggtccncaggctccgagggaggctgggagtggctcgtctataggtggaagtggtgcttatacaaactcgcacgaccctccggtggaacgggccctcgttaccaccatcctcccgaagacgactacttaccaagacgactactctagtanctgacaaatggaacngcctgagtcgaccgagaccacggtccctagtattatgtgacgtaaagttggggtagggggnggttgggggcttacgcgttggtcgtttgacgttacgtcggggcgtaacgggg

SEQ ID NO: 313668 - DNA, 559 bp, Homo sapiens
  misc_feature: GZ8MTXP01BEQO0.39.71.G05.1.454.CMB.2.raw
  modified_base (300)..(300): a, c, t, g, unknown or other
  misc_feature (300)..(300): n is a, c, g, or t
  modified_base (416)..(416): a, c, t, g, unknown or other
  misc_feature (416)..(416): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctccagatatcactggagaaatagtgatgacgcagtctccagccaccctctctgtgtctccaggagaaagcgcccaccctctcctgtagggccagtcagagtgttagctacaacttagcctggtaccagcagaaacctggccaggtcccaggctcatcatctatggtncactccacgacgggccacgtggtactccagcctaccctttaggcggctaggtgggtctggggaacaggtacgttcacttctacaactatcagcacgcctgctagtctagtaagttntttgacttagttttactacgttgtaacaaacgtagtaactaagtcgtacgtcggtccttctacttacggttcggggcggtaagggaccgtaagggttggaacgtaacttacgaaacgcgtggtcggctgaccactcgttctcg

SEQ ID NO: 313669 - DNA, 578 bp, Homo sapiens
  misc_feature: GZ8MTXP01A1MLS.39.71.G05.1.454.CMB.2.raw
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
  modified_base (293)..(293): a, c, t, g, unknown or other
  misc_feature (293)..(293): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtggtcttttctgtggctaattttaaaggtgtccagtgtgaggtgcagctgttggagtcgtgggggagcttggtacaggccgggggggtccctgagactctcctgtgcagcctctggattcaccttnagcagctangccatcgaccgtgggtcccnccgaggcctccgagggggaacggctgggagtgggtctcggtcttagttaggtggaagttggtgactttagaaccaaactcgacacgtccctccggtggaacgggcctcttaccaccatcctaccagtagactactaccaagagacactctgtactctgactaaatcgggaacacgcctagacgtcgccgaggaccgacggtccctagtattgtgtcgagtaaagttgggtaggggggagttcgggggcttacgtcgtggtcgtttgacgttagtcgggcgtcggg

SEQ ID NO: 313670 - DNA, 741 bp, Homo sapiens
  misc_feature: GZ8MTXP01DN8Y6.39.71.G05.1.454.CMB.2.raw
  modified_base (509)..(509): a, c, t, g, unknown or other
  misc_feature (509)..(509): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggcttattttaaaaggtgtccagtgtgaggtgcagctggttggagtcgtggggggaggcttggtacaggccggggggtccctgagactctcctgtgcagcctctggtattcaccttcagcagctatcgccatcgaccgtcgggtcccgccgaggcctaccgaaggggaacggggactggggaggttcgggtctcggttcttagttaggtgggtaaagttggtagtcttaataacccaaacgtacgcacgtcccgtaccggtaggaacggggccctaccttccaacccctattccctaccgaaaggtacgtaacctaacttacccgaaagtacgacctaacgttccttaggtacttacncgtaaaccaaaagttacgaaaaccgtacggtacccttaggacgtccggaacccggaggaaacccgtaccgggtacccttaagttaagtttacgttgggtaagtaacggttaaaagggttcgggggttaggggggtaacggggttgggggttacccgtttaacggttcccggttggggttaccgttttggacccggttacggttcgggggaacccgttaagggggtaaccccg

SEQ ID NO: 313671 - DNA, 673 bp, Homo sapiens
  misc_feature: GZ8MTXP01DC0SB.39.71.G05.1.454.CMB.2.raw
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctggttggagtcgtggggggaggtcttgggtacgagggcccggggggggtccctggagactctcctgtgcagcctctggattccaccttnagcagctangccatgacctgggtcccncaggcctccgaggggaggactggagtgggtctcgtctagttaggtggaagtggtgactttacgaaccaaactcgcagccccttacccggtggaaacggggcccgtctttacccgaaccctaacgttcctaccccaagtacgtaacttaacttacccaaagacgacctaacctcttagtaactcttagactaaataggaaacacgtcccgtaggagtcgacccggaacggaaccgaccggtaccccttaattaactttattggtacggacggtaaagttggggtaggggggtaaggttcggggggttccttacggttccggtgggttcgtttttacggacgttacgggtcgggggttccgtaacggggg

SEQ ID NO: 313672 - DNA, 580 bp, Homo sapiens
  misc_feature: GZ8MTXP01A6YH0.39.71.G05.1.454.CMB.2.raw
  modified_base (266)..(266): a, c, t, g, unknown or other
  misc_feature (266)..(266): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtgggggagcttggtacaggccgggggggtcctgagactctcctgtgcagcctcgtggattcaccttnagcagctatgccatgaccgtggcccgcaggctccgaaggggagggactggagtggtctcgtctattaggtggaagttggtgtacttagtaaacccaaactacgcagccctaccggtagaacgggcctcttcaccctatcctaccgagacgactacttaccaagacgctactctagtactctacgacaaatgaacagccgtagacgtcgcgacgaccgacggaccctagtattatgtcgaggaaagtgggttagggggaggtgggggcttacgttccgtaaggtcgtttgacgtcgttcggggtcgaagggtccg

SEQ ID NO: 313673 - DNA, 720 bp, Homo sapiens
  misc_feature: GZ8MTXP01A0Z17.39.71.G05.1.454.CMB.2.raw
  modified_base (367)..(367): a, c, t, g, unknown or other
  misc_feature (367)..(367): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtggtcttttctaggtggctattttaaaggtgtcagtgtgaggtgcagctgttggagtcgtgggggagcttggtacaggccggggggtccctgagactctcctgtgcagcctcgtggattcaccttcagcagctatgccatcgaccgtgggtccgccacggctccgaagggacgggactgggaggttgggtctcggtacttattaggtaggaagttggtagcctttaaanaacccaaacgtcgacgacgtcccgtaacgggacgaaccgggtccctccttaccacctactccgtacgagtactacttaactaccgaaagaccgtactacgttcgttagtacgtacgtacgtaacgtaaacgtaacgaacgacgtaccgtacggtacggtacggaccggaccggaccggtacccggtaccgttaacgttacgtttacgttacggttaacggtaacgggttaagggttagggggttagggggtacgggggtacgggggttaccggttccggttccggttaacgggttacgggtttaacggttacggttaccgggttacggggtaaccgggttaacgggtaaccgg

SEQ ID NO: 313674 - DNA, 594 bp, Homo sapiens
  misc_feature: GZ8MTXP01C1DD2.39.71.G05.1.454.CMB.2.raw
  modified_base (193)..(193): a, c, t, g, unknown or other
  misc_feature (193)..(193): n is a, c, g, or t
  modified_base (357)..(357): a, c, t, g, unknown or other
  misc_feature (357)..(357): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctntctgtgtctccaggagaaagcgccacctctcctgtagggccagtcagagtgttagctacaacttagcctggtaccagcaacgaaacctggccaggttccccaggctcatcatctagtggtgcactccacagggccacgtcggtactccagccctacgtttaagngcgagtgggtctagggacagtagttcactctcacatcagcagcctgctagtctagtaacgtatttttcggacttaagttttacttaacgtcgtaacaacgtaaagttaacaaattcggaaccttcgggtaacccttcgttccgttaacgtttccggggacgggtaacggggttaaacccgttaggggttaggaaacgtaattaaccgaaaaccggtacgttggtaacgggcttaacg

SEQ ID NO: 313675 - DNA, 807 bp, Homo sapiens
  misc_feature: GZ8MTXP01CLAMQ.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggcttattttaaaaggtgtccagtgtgaggtgcagctggttggagtcgtggggggaggtcgttggtacagggcccggggggtccctgacgactctcctgtgcagcctcgtggtacttccacccttcagcagctatcgccatcgaccgtcgggtcccgccgaggcctccggaaggggaacgggcgtgggaggttcgggtctcggttacttagtttaggtgggtaaaggttgggtacgtactttaaactaaaccccgtaaaaccgtacggacaaccggtcccgtaacccgggttacgggaaccgggggtccctacccgttacccgtaaccccgtacgttacccgtacccgaaaggaacgtaacccttaacttacccgaaaggaccgtacctaaaccgttccgttagtacttaccgttacgaaaccgtaaaattccgaaacggtacggtacccgttaggtacgggtacggaccccggaacgggtaaccctacccgggtaaccctttaatttacgtttaacgttgggtaacggttaacggaaagggttgggggttacggggggtaacgggttcgggggttaccgttaccgttccgggttgggtttcggttttaacggtaacggttcggggaccggggtaaccggaacggggtaacccgg

SEQ ID NO: 313676 - DNA, 534 bp, Homo sapiens
  misc_feature: GZ8MTXP01E0ADG.39.71.G05.1.454.CMB.2.raw
  modified_base (193)..(193): a, c, t, g, unknown or other
  misc_feature (193)..(193): n is a, c, g, or t
  modified_base (214)..(214): a, c, t, g, unknown or other
  misc_feature (214)..(214): n is a, c, g, or t
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
  modified_base (440)..(440): a, c, t, g, unknown or other
  misc_feature (440)..(440): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctntctgtgtctccaggagaaagngccaccctctcctgtaggccagtcagagtgttagctacaacttagctggtaccagcagaacctggccaggttccccaggctcatcatctatggtncatccacgagggccactggtactccagcccaccgtttaagnggcaggtgggtctggggacaggtagttcactctcaccatcagacacgtcctgctagtctagtaagtagttttgacttagtttattacgtntacgaactagtaactaatgactggcctcttctacgtttcggacggacgggaccgagggttagtaaggactaacgaaacgacttgtcggctaacg

SEQ ID NO: 313677 - DNA, 619 bp, Homo sapiens
  misc_feature: GZ8MTXP01EVACR.39.71.G05.1.454.CMB.2.raw
  modified_base (185)..(185): a, c, t, g, unknown or other
  misc_feature (185)..(185): n is a, c, g, or t
  modified_base (310)..(310): a, c, t, g, unknown or other
  misc_feature (310)..(310): n is a, c, g, or t
tcagtcgcactagtcacgaccggtgctcgatttagtgtcgtcgcaagagagagggggggaggaactgctcagttaggacccagacggaaccatggaagccccagcgcagcttctcttcctcctgctactctggctcccagatatcactggagaaatagtgatgacgcagtctccagcccaccctntctgtgtctccaggagaaagcgcccaccctctcctggtacgggccagtcagagtgttagctaacaacttagcctggtaccagcaagaaacctggaccaggttcccaggctcatcatctagtggtncatccaccgacgggcctacgtcggtactcccgacgtccctaacccgtttaggtggcgtagggtcggggtactaggggaactaggtacgttccaccttcgtacaccatcagtcgacgcctgactagtctaggtaacgttatttcgattaagttttatacgttacgtaacaaactagtaactagtacgtacgtacggttccctcgttaccgtcggtttcgggggaacgggtaagggaccggaaggggttacggagtaacgttaacgaaacggttacgttgggcgtctacggccacctaagttccgttaacg

SEQ ID NO: 313678 - DNA, 259 bp, Homo sapiens
  misc_feature: GZ8MTXP01BL2QZ.39.71.G05.1.454.CMB.2.raw
  modified_base (256)..(259): a, c, t, g, unknown or other
  misc_feature (256)..(259): n is a, c, g, or t
tcagtcgcactagtcacgaccggtgctcgatttagtgtcgtcgcaagagagaggggggagtgggggctactcctggcgttttaactactgggggccagggagccctggtcaccgtctcctcagcctccaccaagggcccatcggtcttcccctggcgccctgctccaggagcacctccgagagcacagcggcctgggctgcctggtcaaggactacttccactagtgcgactgagcgggctggcaaggcgcatagnnnn

SEQ ID NO: 313679 - DNA, 583 bp, Homo sapiens
  misc_feature: GZ8MTXP01B7OD7.39.71.G05.1.454.CMB.2.raw
  modified_base (208)..(208): a, c, t, g, unknown or other
  misc_feature (208)..(208): n is a, c, g, or t
  modified_base (341)..(341): a, c, t, g, unknown or other
  misc_feature (341)..(341): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgcctactctggctcccagatatcactggagaaatagtgatgacgcagtctccagcccaccctctctgtgtcctccgaaggggaaangtccaccctctcctgcagggccagtcagagtgttagcagctaaactgcctggtaccagcaagaaacctggccaggcctcccgaggcctcctcatctatgactcgccctaccaccgacggcctacgtcggtacncccgagccccgtaggttcaggtcggactaaaggttgggtcgtacggggacaggtacgttccaactcctacacctatcagcacgcctagctagtcagtaagttatttcgacttaggtttaacttcgtacgtactaaactacgtaacaagtcgtactcggtccttcgtcgtaacgttcgggacgggtacgacgtaaagggtcgaagcttaacgaaagtacgtggtcggcttacgcttaaccgtg

SEQ ID NO: 313680 - DNA, 689 bp, Homo sapiens
  misc_feature: GZ8MTXP01BDLS3.39.71.G05.1.454.CMB.2.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
tcagtcgcactagtcacgaccggtgctcgatttagtgtcgtcgcaagagagaggggcccagccctgggattttcaggtgtccagtgtgaggtgcagctgttggagtctgggggaggcttggtacaggccgggggggtccctgagactctcctgtgcagcctctggattcaccttcagcagctatgccatgacctggtccnccaggctccgagggaaggactgggagtgggtctcgtntagttagtggaagtggtncttanacaaactcgcagcctcgtgaacggccncttcaccatcnccaganactatccaagacgctactctgtactctgacaaatgaaaccngctgacgtcggaaccgaggaaccaccgggtacccttaagtatttagtggtagacgtaaagttggggtaggggggtaggtcgggggtacttacgtccggttgggttcgttttacggacgttacggtcgggggaccgtaggggacggtccccgttgggtcccgacccggttcctccccgtctaaccggtccccttaccccgaacccggtaaccggggtccccaacggtttccccggggttcccctttcccccggtcgggccccgtccccgttcggccccgttcccggacggggtcccgacccgaaccccggttccggaacggaccggtaaccaacccgggcccggg

SEQ ID NO: 313681 - DNA, 706 bp, Homo sapiens
  misc_feature: GZ8MTXP01CPAN5.39.71.G05.1.454.CMB.2.raw
  modified_base (450)..(450): a, c, t, g, unknown or other
  misc_feature (450)..(450): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggtcttaattttaaaaggtgtccagtgtgaggtgcagctggttggagtcgtgggggaggttggtacgagggccggggggtcctgagactctcctgtatacgcctctggtattctacctttagacaactatcgccagtggtaggtcgggtcccgaccgaggccgtaccggaaggggaacggggctggacgtagggtcgggtcctacggtaggttcgttagggtagggtaaagggttgggtaggtaaggactaagtaacgtacgaccacggtacgtccggtaggaacgggtcccgttacnccgtctacgaagacgaactaactaccgaaagaaccaacacgtagtactctagaaactaaagtacgaaacgacgaccgtagaacggaccgacggggaacgaaccgacggtaccgtaattaacgtacgtaggaacgtaagaaaagtagtaggttaattgggtagttaggtttttaggaggttacggttaggttacgggttattacggttaagtaccgttaaggtcggggtaccgacgggtaacccgttcggtaacccg

SEQ ID NO: 313682 - DNA, 584 bp, Homo sapiens
  misc_feature: GZ8MTXP01ECA7R.39.71.G05.1.454.CMB.2.raw
  modified_base (329)..(329): a, c, t, g, unknown or other
  misc_feature (329)..(329): n is a, c, g, or t
tcagtcgcactagtcacgaccggtgctcgatttagtgtcgtcgcaagagagagggggtcaggctggaactgaggagcaggtgggggcacttctccctctaacactctcccagcgcagcttctcttcctcctgctactctggctccagatatcactggagaaatagtgatgacgcagtctccagccacctctctgtgtctaccaggagaaagcgccacctctcctgtacggccagtcagagtgtagctacacttagctggtaccagcaagaacctggccaggttccaggctcatcatctagtggtgcatccacgagggccactcggtacnccgagccctacgtttagcggcaggtcgggtctggggacagtacgttcactctacacatcagtcacgcctgcgtagtctagaacgttgtttaggacttaagttttactaacgtcgttaacaactaacgtactaaagtggtacctcggtcctttaacgttcgtaacggttttccggggacgggtaacggggaccgttaagggttacgggtaagtaacgtaaccgtaaaacggtacgttgggttcggaacttaaccgg

SEQ ID NO: 313683 - DNA, 588 bp, Homo sapiens
  misc_feature: GZ8MTXP01BAB7B.39.71.G05.1.454.CMB.2.raw
  modified_base (194)..(194): a, c, t, g, unknown or other
  misc_feature (194)..(194): n is a, c, g, or t
  modified_base (317)..(317): a, c, t, g, unknown or other
  misc_feature (317)..(317): n is a, c, g, or t
  modified_base (340)..(340): a, c, t, g, unknown or other
  misc_feature (340)..(340): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggaagaaatagtgatgacgcagtctccagccaccctntctgtgtctccaggagaaagcgccaccctctcctgtacgggccagtcagagttgttagctaacaacttagcctaggtaccagcaagaaacctggccaggttcccaggctcatcatctatggtncatccacgaggccacgtcgtacnccgagtcctacgtttagcgcgtaggtgggtctaggggactaggtacgttcactctacacatcgagcagtcctggctagtcgtagtaagttagtttgtacgttaagtttattacgtacgtacaaacgtaagtaactaaagtcgtaacgtcggtaacccttcgttaccgtaaccggtttcgggacggggtaacggaaccggttaagggttcggaagtacgtaacgaaaacgtacgttgtcggcgttaacg

SEQ ID NO: 313684 - DNA, 645 bp, Homo sapiens
  misc_feature: GZ8MTXP01CG3GA.39.71.G05.1.454.CMB.2.raw
  modified_base (510)..(510): a, c, t, g, unknown or other
  misc_feature (510)..(510): n is a, c, g, or t
  modified_base (629)..(629): a, c, t, g, unknown or other
  misc_feature (629)..(629): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccgggggggtccctgagactctcctgtgcagcctctggattcaccttcagcagctatgccatcgaccgtgggtcccgccgaggctccgaggggacggactgggagtgggtctcgtctagttaggtggtaagtggtgactttaagtaaccctaaacgtacgacaacgtccccgttacccgggtagggaacggggtcccgtacctttcccgaaccctacttccctaccaagtaaccgtaacttaacgttacccaaagtacgctaacttctacgtatctagaacaaatacgaaacngacccgtgacggtcgaccggagaccgaccggtcccttaattacgttagttggtaagaggttaaagtggggttacgggggaggtcggggcgttacgttccgtggtcgtttgacgtacggngggtccgaaggtccgg

SEQ ID NO: 313685 - DNA, 602 bp, Homo sapiens
  misc_feature: GZ8MTXP01EHITZ.39.71.G05.1.454.CMB.2.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (324)..(324): a, c, t, g, unknown or other
  misc_feature (324)..(324): n is a, c, g, or t
  modified_base (505)..(505): a, c, t, g, unknown or other
  misc_feature (505)..(505): n is a, c, g, or t
  modified_base (595)..(595): a, c, t, g, unknown or other
  misc_feature (595)..(595): n is a, c, g, or t
tcagtcgcactagtcacgaccggtgctcgatttagtgtcgtcgcaagagagaggggggtcaggctggaactgaggagcagggtgggggcacttctccctctaacactctccccagcgcagcttctcttcctcctgctactctggctcccagatatcactggagaaatagtgatgacgcagtctccagccacctntctgtgtctcagganaaagacgcccacctctcctggtagggccagtcagagttgtagcagctaacttgcctaggtaccagacaagaaacctggccaggttccccaggtctacatcatcgtagtcgggtanactactcccgaacgtacgggcctacgtcggtactcccgacgtaccctaaaccgtttaggcggactagggttcgggtctaggggactagttacgttaccacttactacaactatacgaacggcctaacggccctggctacgttacgtagtaaggttacgttttggctttaagtttatacgtntacaactagtactaagttcacgtcgtcttcgtacgttacggttacgggcggacggttacgagggtgataacgtaccgaaaggttacgtgnggtaacc

SEQ ID NO: 313686 - DNA, 634 bp, Homo sapiens
  misc_feature: GZ8MTXP01CGN6G.39.71.G05.1.454.CMB.2.raw
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtgggggagtcttggtacgagggccggggggtcctgagactctcctgtgcagcctcgtggattccaccttnagcagctancgcatcgaccgtgggtcccgccgaggctaccggagggggaacggcgtgggagtgggtctcgtactagtggtaggagtggtatacttaacaacaactcgcacgcccgtcggtggaacgggccctcttaccacctcttccacacgtagtacctagttacccaagtacgactactcgtagtactctagactaaagtacggaaacgtacggcctaggagtcggaccggaaggacccgaccggtacccttaagttacttagttggtagttacggtaaaggttggggtagggggtggttcgggggttcttaccggtcggtcggttcggtttcggacgttacgggtcgggttcggtaacgggg

SEQ ID NO: 313687 - DNA, 258 bp, Homo sapiens
  misc_feature: GZ8MTXP01B3TR0.39.71.G05.1.454.CMB.2.raw
  modified_base (255)..(258): a, c, t, g, unknown or other
  misc_feature (255)..(258): n is a, c, g, or t
tcagtcgcactagtcacgaccggtgctcgatttagtgtcgtcgcaagagagaggggggagtggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnn

SEQ ID NO: 313688 - DNA, 607 bp, Homo sapiens
  misc_feature: GZ8MTXP01B5G8I.39.71.G05.1.454.CMB.2.raw
  modified_base (194)..(194): a, c, t, g, unknown or other
  misc_feature (194)..(194): n is a, c, g, or t
  modified_base (318)..(318): a, c, t, g, unknown or other
  misc_feature (318)..(318): n is a, c, g, or t
tcagtcgcactagtcacgaccggtgctcgatttagtgtcgtcgcaagagagaggggggtcaggctggaactgaggagcagggtgggggcacttctccctctaacactctccccagcgcagcttctcttcctcctgctactctggctccagatatcactggagaaatagtgatgacgcagtctccagccaccctntctgtgtctcgaggagaaagcgccaccctctcctggtacgggccagtcaggtagttgtagctaacaacttgctggtacagacaagaaccgtggccacggttcccaggctcatcatctagtggtnctactccacgaggcctacgtcggtactccagtccctaacgtttaaggcggcgtacgggtgggtcgtaggggactaggtacgttcacctctaccactagtacagacgacgtcctagcctagtctaagtaacgttagttttcgactttaagtttactactgtaaccaaagtacgtaactaagtcgtacgtcggtccttcgttacgtacgttacgggacggtaacgggttaccgttaagggttaggtaagtaacgtaacgaaaaccggtcggttaggtcggttaactaacgg

SEQ ID NO: 313689 - DNA, 798 bp, Homo sapiens
  misc_feature: GZ8MTXP01AVBVY.39.71.G05.1.454.CMB.2.raw
  modified_base (373)..(373): a, c, t, g, unknown or other
  misc_feature (373)..(373): n is a, c, g, or t
  modified_base (438)..(438): a, c, t, g, unknown or other
  misc_feature (438)..(438): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtgggggagtcgttggtacgaggcccgggggggtccctgagactctcctgtgcagcctctggattcaccttcagcagctatgccatcgacctgggtcccgccaggctccgaaggggaagggctggaggtcgggtctcggtctaagtttaggtagggtaagtgggtgtactttaanaacccctaaactacggccaaggtcccttacccgggtagaacgggggcccctacttcccaaccctnttctacccgaagacgtactaattacccgaaagtacgactaacttccttagtactccgttagaactaaaagtacggaaacaacggtcccgttaggaaacgggttccggaaccccggtaacgggtaaaccccgaacccgggggttaaccccctttaaaggtttaaaccttttaacgtttaacggggttaagggtaaacccgggttaaaaaggggtttcggggggttaacgggggggggggtaaaggggttcggggggggggttaaccctttaaccgggttccccggttaagggggttcccggttttttaacgggaccgttaaccggggttcgggggtaacccggttaaacgggggtcccggg

SEQ ID NO: 313690 - DNA, 795 bp, Homo sapiens
  misc_feature: GZ8MTXP01A1SSY.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttctgtggctattttaaaggtgtccagtgtgaggtgcagctgttggagtcgtgggggaggcttggtacaggccgggggggtccctgagactctcctgtgcagcctctggattcaccttcagcagctatgccatcgacctgggtcccgccaggctccgagggagggactgggagtgggtctcgtctagttaggtgggaaagttgggtagtacttataaccccaaacgttcgacacgtcccgttaacccgggtaggaacggggcccgtccgtttaccaccccaattcccgtaccccgtaaggaacgtaaccctttacttaaccccgaaaggaaccgacctaacccttacgttacggttaacttacccgtggtaaaccaaaacgtttacgggaaaacctacggtaccccgttaggggtacgttacgggaccccggaaagggtacccgtaaacccggggtaccccttaagttaattttaccgttagggtccggtaacggttaaaagggtttcggggggttaggggggggtacggggttacgggggggttaccctttaccgggttccccgggttggggtttccgggttttttaacgggaaaccccggtttacggggttccggggggtaacccggttaaacggggggttcccccggg

SEQ ID NO: 313691 - DNA, 261 bp, Homo sapiens
  misc_feature: GZ8MTXP01B9X4B.39.71.G05.1.454.CMB.2.raw
  modified_base (256)..(261): a, c, t, g, unknown or other
  misc_feature (256)..(261): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnnnn

SEQ ID NO: 313692 - DNA, 528 bp, Homo sapiens
  misc_feature: GZ8MTXP01AMVMA.39.71.G05.1.454.CMB.2.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (320)..(320): a, c, t, g, unknown or other
  misc_feature (320)..(320): n is a, c, g, or t
  modified_base (338)..(338): a, c, t, g, unknown or other
  misc_feature (338)..(338): n is a, c, g, or t
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagcccaccctctctgtgtctccagganaaagngccaccctntcctgtagggccagtcagngtgttagctacaacttgctggtaccagcagaacctggccaggtcccaggctcatcatctatgtgcatccacgagggccagtggtacncccagcctacctttaggngcgagtggtactgggaacngagttcactctcacctatcagcacgctgcagtctagaagtntttgactagtttatactgtacaacagtaacagtcgacgtcgtctctctacgttcgggaacggagggaccgtaaggttggaacgtattacgaaacgaacgtcggtggcgtcgacttacctaagttcgttcg

SEQ ID NO: 313693 - DNA, 587 bp, Homo sapiens
  misc_feature: GZ8MTXP01BE4JM.39.71.G05.1.454.CMB.2.raw
  modified_base (214)..(214): a, c, t, g, unknown or other
  misc_feature (214)..(214): n is a, c, g, or t
  modified_base (313)..(313): a, c, t, g, unknown or other
  misc_feature (313)..(313): n is a, c, g, or t
  modified_base (395)..(395): a, c, t, g, unknown or other
  misc_feature (395)..(395): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccaggagaaagngccacctctcctgtagggccagtcagagtgttagctacaacttagcctggtaccagcaagaaacctggaccaggttccccaggctcatcatctatggtncatccaccgaggccacgtcgtactccagtccctacgttaagcgcgtaggtgggtctggggacaggtacgttcactctacacntcagcacgctgcagtctagtaagttacgtttgacgtttaagtttacttacgtcgtaactaaacgtaacgttaactaacttctaccgtcggtaacccttcgttccgtacggtttccggggacgggtaacgggttaaccgttagggttacggaagtacgttaaccgaaaacggtcttagggtcgttcgtaaccg

SEQ ID NO: 313694 - DNA, 602 bp, Homo sapiens
  misc_feature: GZ8MTXP01CETL9.39.71.G05.1.454.CMB.2.raw
  modified_base (194)..(194): a, c, t, g, unknown or other
  misc_feature (194)..(194): n is a, c, g, or t
  modified_base (216)..(216): a, c, t, g, unknown or other
  misc_feature (216)..(216): n is a, c, g, or t
  modified_base (313)..(313): a, c, t, g, unknown or other
  misc_feature (313)..(313): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagcccaccctntctgtgtctccaaggagaaagngccaccctctcctgtagggccagtcagagtgtagctacacttagctggtacagcaagaaacctggaccaggttcccaggctcatcatctagtggtancactccaccgacgggccacgtcggtactccgagtcccctaacgtttaaggcggcgtagggtgggtctaggggaacaggtacgttcactctacacctataccagcacgcctgctagtcgtagtaacgttgtttgacttagttttactacgtgtacaacgtagtactaaagtcgtactcggccttcgttacgtaccggtttcggggacgggtacggggttaaaccgttaaggggttcggtaaacgtaacgttaaccgaaaacggttacgttacgggtcggaacgtaaccgg

SEQ ID NO: 313695 - DNA, 258 bp, Homo sapiens
  misc_feature: GZ8MTXP01CZGRJ.39.71.G05.1.454.CMB.2.raw
  modified_base (249)..(249): a, c, t, g, unknown or other
  misc_feature (249)..(249): n is a, c, g, or t
  modified_base (255)..(258): a, c, t, g, unknown or other
  misc_feature (255)..(258): n is a, c, g, or t
tcagtcgcactagtcacgaccggtgctcgatttagtgtcgtcgcaagagagagggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcncatagnnnn

SEQ ID NO: 313696 - DNA, 258 bp, Homo sapiens
  misc_feature: GZ8MTXP01AWWTI.39.71.G05.1.454.CMB.2.raw
  modified_base (255)..(258): a, c, t, g, unknown or other
  misc_feature (255)..(258): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggcctgggctgcctggtcaaggactacttccactagtgcgactgagcgggctggcaaggcgcatagnnnn

SEQ ID NO: 313697 - DNA, 703 bp, Homo sapiens
  misc_feature: GZ8MTXP01ESWCJ.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggcttaattttaaaaggtgtccagtgtgaggtgcagctgttggagtcgtgggggagtcgttggtacgagggccggggggtcctgacgtactctccgtgtgcagtcctcgtggtacttccaccttcagcagctatgccatcgaccgtcgggtcccgccaggcctaccggaaggggaacggggtactgggacggtgggtctcggttactagtttaggtgggaaagttggtgtacttaataaacccaaacgtcgacacgtccctaaccggtaggaacggggccctacttaccgaccctattcctaccgagacgtaacttaacttacccgaaagacgacctaactcgttagtactctacgaactaaaagtcgaaacgacggtaccgttaggaacgtcggaccggaacggaccaaccgggtccctaagttacttagttcgtaaggtacgttaaagggtggggttagggggtacgggttcgggggttaccgttacgttccggtaagggttcggtttaacgaccggttacgggcgggggtaaccgaacggggtcccgg

SEQ ID NO: 313698 - DNA, 573 bp, Homo sapiens
  misc_feature: GZ8MTXP01D2GXG.39.71.G05.1.454.CMB.2.raw
  modified_base (193)..(193): a, c, t, g, unknown or other
  misc_feature (193)..(193): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctntctgtgtctccagganaaagngccacctntcctgtaggccagtcagagtgtagctanaacttagccnggtaccagcaagaaacctggccaggtccaggctcatcatctatggtncancacgagcacgtcgacncagtcctacttaagngcagtgggtcaggacagtagtcactctacacatcagacacgctcgcagtacgtagtaagtagtttagtacttaagtttaacttaacttacgtacgtaaacgtaaacgtaaactaaatacgtacgtacgtccgtccgttacgtacgttacgggtacgggtaacgggttaacggaaacggttaacggtaaggtaacgtaacgtaaaacgtaaacgttacgtaacgttcgtaacg

SEQ ID NO: 313699 - DNA, 670 bp, Homo sapiens
  misc_feature: GZ8MTXP01AHV8R.39.71.G05.1.454.CMB.2.raw
  modified_base (352)..(352): a, c, t, g, unknown or other
  misc_feature (352)..(352): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggaggcttggtacaggccgggggggtccctgagactctcctgtgcagcctctggattcaccttcagcagctatgccatgacctgggtcccgccaggctccgagggagggactgggagtgggtctcgtctagttagtggaagtggtgtcttanaccaaactcgctagccctacgtggaacgggccgcttccaccatctaccagacgactaacttaccaagtacgacactctagtactcttagacaaatcgaacgacgtccgtggaacggttcgacccgggaacggaacccgtaacccgggtaccccttaaattaacgtttaagtttgggtaacggtaccggttaaaaggttcgggggttaggggggggtaagggttcggggggggttacccttacgttcccgggttgggttaccgggttttcggaacggttaccggggttcgggggaaccgttaacgggggtaaccccggg

SEQ ID NO: 313700 - DNA, 737 bp, Homo sapiens
  misc_feature: GZ8MTXP01C9278.39.71.G05.1.454.CMB.2.raw
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttcttgtggctattttaaaaggtgtccagtgtgaggtgcagcttgttggagtcgtgggggaggtcgttgggtacgagggcccgggggggtccctggagacctcgtcctgtgcacgcccttcgtggtattccaccttcagcagctatcgccagtcgaccgtgggtcccgaccaggcctaccggaaggggaaggtacgtgggtaggtgggttcctcgttacgttaagttaggtaggtaaggttggtacgtactttaacaacctaaacgtcgacacgtcccgtacggtcgggaaacgggtccctaccgttaccaacctacttcccgtaccctaagtacgtaaccttacgttacccgaaaggtacgacctacttcgttagtacttcgtacgtaacgtaaattacgggaaacgtacgtacccgtaggaggtccggacccggaacggaaaccctacccgggtacccttaagttacgtttagttaaggtacggttacggtaaagggttgggggtaggggggtaaggttcgggggttccttacggttccggtagggtttcggttttacggacgttaccgggtcggggcccggtaacgggg

SEQ ID NO: 313701 - DNA, 823 bp, Homo sapiens
  misc_feature: GZ8MTXP01AUONX.39.71.G05.1.454.CMB.2.raw
  modified_base (251)..(251): a, c, t, g, unknown or other
  misc_feature (251)..(251): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttctgtggctatttaaaggtgtccagtgtgaggtgcagctgttggagtcgtggggggagcgttggtacaggccgggggggtccctggagactctcctgtgcagcctntggattcaccttcaggcagctatcgcctatcgaccgtcggggtcccgccgaggcctcccggaagggggaacggggacgtggggaggtcggggttctcggttcgttaagtttagggtgggtaaaggttgggttagtaccgtttaaacgtaaacccgtaaaaccgtacggacctaacgggtcccccgttaaccgggtaacggggaaccgggggtccccgtaccgtttacccaaccccggtattaccccgttacccgaaagtaaccggtaacttaaccgtttacccgaaacggtaccgtacctaaccgttccgttagttacctacgttacgaaccgtaaataacggaaccgtacgtccgttaggacggtacggacccgggaacggacccgtaacccgggtacccttaagtttaacgtttaacggttgggttaacggtaaccgggttaaagggttacggggggttggggggggtaaacgggttcggggggggttacctttaccggttcccgggttgggttacggttttaacggtaaccgggttcggttacgggggtccgttaacgggggtccccgg

SEQ ID NO: 313702 - DNA, 622 bp, Homo sapiens
  misc_feature: GZ8MTXP01A3RNW.39.71.G05.1.454.CMB.2.raw
  modified_base (295)..(295): a, c, t, g, unknown or other
  misc_feature (295)..(295): n is a, c, g, or t
  modified_base (403)..(403): a, c, t, g, unknown or other
  misc_feature (403)..(403): n is a, c, g, or t
  modified_base (429)..(429): a, c, t, g, unknown or other
  misc_feature (429)..(429): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggcttattttaaaaggtgtccagtgtgaggtgcagctgttggagtcgtgggggaggtcttggtacaggccgggggggtccctgagactctcctgtgcagcctctggattcaccttcagcagctatgccatcgacctgggtcccnccgaggcctccgaggggagggactggagtgggtctcggtctagtaggtgggagtggtgacttatacccaaactcgacacgccctacggtgaacgggcctcttcacctntcctacagacgtactactaccaaganctactctgtactcgtgacaaatacgtaacgacgtccgtaggaggtacgccggaacggaccgaaccgggtacccctaagttatttacgttggtaacggtacggttaaaggtggggttggggggaagggttgggggacgttcggttccgtgggttcgtttcgacgtacgggttcggggtccggaaggggtcccgg

SEQ ID NO: 313703 - DNA, 768 bp, Homo sapiens
  misc_feature: GZ8MTXP01CF3C2.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagttgggctgagctggtctttttcttgtggcttaattttaaaaggtgtccagtgtgaggtgcagctggttggagtcgtggggggaggtcgttgggtacgacgggcccgggggggtcctggacgactctcctgtgcagcctcgtggacttcaccttcagcagctatgccatcgaccgtcgggtccgcgaggcctcggaagggacgggacgtggagtcgggtctcggttcttagtttaggtagggaaggttggtacgtactttaaataaaccccgtaaaaccgttacgctaacggtccccgttaaccgggtacgggaaccggggccctacccgttaccaacccctagtacccctaccgaaacgtacgtaacttaacgttacccaaaggaacgtccctaacgttccgttagttactacgttacgaacctaaaagttaccgaaaaccgtacgtcccgttaaggacggtccggacccggaacggaaccgtaacccggtacccttaaagttacttagttcggtaaggtaacggttaaagggttgggggttcggggggtaagggttcgggggttaccgttacggttcccggttggttccggtttaacgggaccgttacggggttacggggtaaccggaacggggtaacccgg

SEQ ID NO: 313704 - DNA, 593 bp, Homo sapiens
  misc_feature: GZ8MTXP01BPCZP.39.71.G05.1.454.CMB.2.raw
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (323)..(323): a, c, t, g, unknown or other
  misc_feature (323)..(323): n is a, c, g, or t
  modified_base (346)..(346): a, c, t, g, unknown or other
  misc_feature (346)..(346): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
  modified_base (428)..(428): a, c, t, g, unknown or other
  misc_feature (428)..(428): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtgtcgttttctagtggctattttaaaggtgtcagtgtgaggtgcagctgttggagtcgtgggggagcgttggtacgaggccggggggtccctgagactctcctgtgcagcctctggattccacttcagcagctangccatcgactggccncgagctaccgagggacggactggagtggtctcgtnttagtttaggaggtaagtcggtntacttaacaacaacgtcgcncgtcccgtcgnggacggtcctactacacgtctcacagtactactactacgagacgactactntgtactactacgacaagacgacgacgtacgtacgacgcgacgacgacgacgtaccgtagttacgttagtaagtagttaggtaggttaggggtaggggtgggttcgggttcggttacgtcggttcggttcggttacggtacggttacggtcgggttcgggtaacgg

SEQ ID NO: 313705 - DNA, 640 bp, Homo sapiens
  misc_feature: GZ8MTXP01ARTPA.39.71.G05.1.454.CMB.2.raw
  modified_base (193)..(193): a, c, t, g, unknown or other
  misc_feature (193)..(193): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctntctgtgtctccagganaaagngcccacctctccgtgtacgggccagtcagagtgttagctacaacttagcctggtaccagcaagaaacctggacctacggttcccaggctcatcatctagtggtncactccacgnggccagtcggtactccgagtccctacgtttaaggcggtcgagggtttcggggtactgggggaactagggtacgtttaccacttctaccaacctatacgacgacgtacgccgtagactaggttactaggtaaagttcgttttcgacgtttaattttacgttactcgtactaaacgtacttaaacgtaacgtttacggacgtccggtaaccttccgttacgtaacccggttttcggggaccgggtaacgggaacccggttagggttacgggaagacgtaacgaaaaccggtacgttaggtcggttaactccggg

SEQ ID NO: 313706 - DNA, 257 bp, Homo sapiens; identical to SEQ ID NO: 313628
  misc_feature: GZ8MTXP01DFRBR.39.71.G05.1.454.CMB.2.raw
  modified_base (256)..(257): a, c, t, g, unknown or other
  misc_feature (256)..(257): n is a, c, g, or t

SEQ ID NO: 313707 - DNA, 644 bp, Homo sapiens
  misc_feature: GZ8MTXP01CMV0W.39.71.G05.1.454.CMB.2.raw
  modified_base (337)..(337): a, c, t, g, unknown or other
  misc_feature (337)..(337): n is a, c, g, or t
  modified_base (387)..(387): a, c, t, g, unknown or other
  misc_feature (387)..(387): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggagcttggtacaggccgggggggtcctgagactctcctgtgcagcctctggattcaccttcagcagctatgccatcgacctgggtccgccaggctccgaggggaaggctgggagtgggtctcgtctagtttaggnggaagttggtgtcttaataaccaaactcgcagccctacgtgaacgggccncttcaccatctaccagacgactacttaccaagacgcactctagtactctagacaaatgaaacgagccctgacgtcgacccggacggaccaccgggcccttaagtactttagttggtcgtaacggttaaaggttgggggttagggggggtaacgggtcggggggttaccttacggttccccggttgggggttccggtttttaacggaaccggtttaccggggttacgggggtaaccccgttaaggggggtaaccccgg

SEQ ID NO: 313708 - DNA, 568 bp, Homo sapiens
  misc_feature: GZ8MTXP01D0PFM.39.71.G05.1.454.CMB.2.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (315)..(315): a, c, t, g, unknown or other
  misc_feature (315)..(315): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (355)..(355): a, c, t, g, unknown or other
  misc_feature (355)..(355): n is a, c, g, or t
  modified_base (387)..(387): a, c, t, g, unknown or other
  misc_feature (387)..(387): n is a, c, g, or t
tcagtcgcactagtcacgaccggtgctcgatttagtgtcgtcgcaagagagagggggtcaggctggaactgaggagcagggtgggggcacttctccctctaacactctccccagcgcagcttctcttcctcctgctactctggctccagatatcactggaagaaatagtgatgacgcagtctccagccaccctntctgtgtctcagganaaagcgccacctctcctgtacgggccagtcagagttgtagctaacaacttagcctggtaaccagacaagaaacctggaccaggtcccaggctcatcatctagtggncatccacgnggccacgtcggtacnccagcctacgtttagngcgagtggctgggacagcttcacttcacaacnacaggcagcctgcagtctaagtaagttgtttcgactttagtttaactactacgtactaaactagttaacaaattcgacctggtcccttcgttacgttacggttcgggaacggggtaacgggttaaaccgttaggggttacggaataacgtaacgaaacgtacgttgggtaacggctaacgg

SEQ ID NO: 313709 - DNA, 685 bp, Homo sapiens
  misc_feature: GZ8MTXP01D5TLA.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggcttattttaaaaggtgtccagtgtgaggtgcagctggttggagtcgtggggggaggtcgttgggtacgacgggccgggggggtccctggagactctcctgtgcagcctcgtggattcaccttcagcagctatcgcagtcgaccgtcgggtcccgcgaggcctacggaagggaagggcgtggaggtcggtctcgtacgttagttaggtggtaaggttggtagtactttaactaacccgaaacgtacgcgtacgtcccgtaacggtacgggaaccgggcccgtcttacccacctactcctaccgagaacgtacttaacttaccgaaagtacgactaacttctagtactctacgactaaagtacgaacgacgtccgtagacggtacgaccggtaacggaccgacccggtaccttaagttaagttacgttggaacggtaacggttaaagggtggggttagggggggtacgtggggaccttacggttcgttaagggttcgtttcgacgtacggggcgggtaacgcggggtaacccg

SEQ ID NO: 313710 - DNA, 684 bp, Homo sapiens
  misc_feature: GZ8MTXP01BD8FB.39.71.G05.1.454.CMB.2.raw
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (394)..(394): a, c, t, g, unknown or other
  misc_feature (394)..(394): n is a, c, g, or t
  modified_base (549)..(549): a, c, t, g, unknown or other
  misc_feature (549)..(549): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttcttgtggcttaattttaaaggtgtccagtgtgaggtgcagctggttggagtcgtgggggaggtcgttggtacgagggcccgggggggtccctggacgactctcctgtgcagcctctggattcacttnagcagctancgaccatcgaccgtcgggtcccgaccgaggcctacccggaagggggaacgggacgtggggaggttcgggtccttcgtacttaagttaggtggtaagtggtagtactttaanaaccgtaaactcgaccacggtccctcccggtggaaacgggtcccgtctttaccacctactcgtacccaagactactacttaccaaaggtacacctactctagtactctagactaaatacgggaacagtaccctagacgccgaccgacggaaaccnccggtacccttaattaactttagtggtaggttaacggtaaaggttgggggtacggggggtaggttcggggggttccttacggtccgtcgggttcgttttacggacgttaccgggttcggggaaccgtaacggggg

SEQ ID NO: 313711 - DNA, 259 bp, Homo sapiens; identical to SEQ ID NO: 313652
  misc_feature: GZ8MTXP01DLJEL.39.71.G05.1.454.CMB.2.raw
  modified_base (256)..(259): a, c, t, g, unknown or other
  misc_feature (256)..(259): n is a, c, g, or t

SEQ ID NO: 313712 - DNA, 259 bp, Homo sapiens; identical to SEQ ID NO: 313652
  misc_feature: GZ8MTXP01BMEVU.39.71.G05.1.454.CMB.2.raw
  modified_base (256)..(259): a, c, t, g, unknown or other
  misc_feature (256)..(259): n is a, c, g, or t

SEQ ID NO: 313713 - DNA, 816 bp, Homo sapiens
  misc_feature: GZ8MTXP01A6JT3.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacaaagagaactcaccatggagtttgggctgagctggctttttctgtggctattttaaaaggtgtccagtgtgaggtgcagctgttggagtcgtgggggagtcgttggtacgaggccggggggtccctggagactctcctgtgcagcctcgtggattccaccttcagcagctatcgccatcggaccgtcgggtcccgccgaggcctaccggaggggaaagggtaccgtgggtacggttcgggtcctcggttacgttaagtttaagggtacgggtaaggttggttacgtaccgtttaaataaacccgtaaaacccgttaccggacctaaccggtccccgttaccgggtaacgggaaaccggggtcccctaccgtttacccaaacccgtacttcccgtacccgaaaggtaaccgtaaccttaacgttacccgaaaggtacgacctaacgttcgtaacgttaactcgttacgaaacctaaaagtacgaaaccgtacggggtacccgtaggggtacgtaccggaccgggaaccggacccgtaacccgggtacccttaagttaacgtttaagttcgggtaacggtaacgggtaaagggttggggggtacggggggaacgggttcgggggtaccttacggttccggtttcggggttaacgttttacggaacggtttaccggggacgggggttacccgtaacggggttcccgttcccggg

SEQ ID NO: 313714 - DNA, 610 bp, Homo sapiens
  misc_feature: GZ8MTXP01ERJQO.39.71.G05.1.454.CMB.2.raw
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
tcagtcgcactagtcacgaccggtgctcgatttagtgtcgtcgcaagagagagggggtcaggctggaactgaggagcagggtgggggcacttctccctctaacactctccccagcgcagcttctcttcctcctgctactctggctcccagatatcactggagaaatagtgatgacgcagtctccagccaccctntctgtgtctccagganaaagcgcccaccctntcctgtacgggccagtcagagttgtagctacaacttagctggtaccagcaagaacctggccacggttcccaggtctcatcatctatggtgcactccaaccgtaggggccacgtcggtactaccgagtccctaaccgtttaaggcggtcgtagggttcggggtctcgggggaactaggtacgttcaccttctacacatcgagtcacgcctgctagtctagaagttagtttcgtacttaagtttacttacgtgtacctaacgtagttaactaagttcgtaccgtcgggtcccttcttaccgtaccggtttcggggaccgggttcggggaaaccgttaggggttagggtaagacgtaaccgaaaccgtagttcggtcggttcgtaacg

SEQ ID NO: 313715 - DNA, 728 bp, Homo sapiens
  misc_feature: GZ8MTXP01B2I9J.39.71.G05.1.454.CMB.2.raw
  modified_base (245)..(245): a, c, t, g, unknown or other
  misc_feature (245)..(245): n is a, c, g, or t
  modified_base (292)..(292): a, c, t, g, unknown or other
  misc_feature (292)..(292): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtggtcttttctgtggctaattttaaaggtgtccagtgtgaggtgcagctggttggagtcgtgggggagtcttggtacaggccggggggtcctgagtactctcctgtncagcctctggattcaccttcagcagctatgccatcgactcgggtccncaggctcaggggagctggagtggctgtctagttaggtggagtcgtgacttatacccgaaactcgactacgccctccgtaggaacggggtcccacctttaccacccgtacttccgtaccccgaaagggacgtaaccttaacgtttacccaaaggtaccgactaaacctttccttacggttagttaccctagtaaaccaaaagttacggaaaccaagtcccgttaggaccgggttacgccggtaaccgggaccgaaacccgggtccccgttaaagtttacttttaacgttgggtaacggtaaacggttaaagggttggggggttcgggggggtaaagggtcgggggggttaaccctttcggttcccggtttggggtacccggtttttggaacccggttccggggtttaccgggggaaccggttcggggtaaccccggg

SEQ ID NO: 313716 - DNA, 713 bp, Homo sapiens
  misc_feature: GZ8MTXP01DA9S1.39.71.G05.1.454.CMB.2.raw
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (359)..(359): a, c, t, g, unknown or other
  misc_feature (359)..(359): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggcttaattttaaaaggtgtccagtgtgaggtgcagcttggttggagtcggtggggggaggtcgttaggtaccgagggccccgggggggtcctggagtacctctcctgtgcagcctctgatcaccttnagcagctancgccatcgaccttgggcccnccaggcctccgaagggaagggctgggagtgggtctcgtcttagtttaggnggtaagttggtagtcttaataacccgaaacttacgcgtaacgcccgttaccgtagaacggggtccctcttacccaactactctcccgaaagacgtactacttaccgaaacgacgtaccaacttccttagtaactccgttagaaccaaagttacgaaaaccggtcgtacccgtaggtacggtcggaacccgacgggaacctacccgggtaacccttaggtaatttacgttaggtccggtaaggttaaggttgggggttaggggggtaacgggtcgggggttccttcgggttacccggtttggtaacgggtttttcgacggttacgggttcgggggtccgttaacggggtcccggg

SEQ ID NO: 313717 - DNA, 738 bp, Homo sapiens
  misc_feature: GZ8MTXP01EHV4D.39.71.G05.1.454.CMB.2.raw
  modified_base (184)..(184): a, c, t, g, unknown or other
  misc_feature (184)..(184): n is a, c, g, or t
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
tcagtcgcactagtcacgaccggtgctcgatttagtgtcgtcgcaagagagagggggggaggaactgctcagttaggacccagacggaaccatggaagccccagcgcagcttctcttcctcctgctactctggctcccagatatcactggagaaatagtgatgacgcagtctccagccaccctntctgtgtctcagganaaagcnccacctctcctgtagggccagtcagtagtgttagctaacaacttgcctaggtacagacagaacctggacctaggtcccaggtctcatccatctagtggtcactatccccgacgacgggtcctacgtggttacctcccgacgtcccgttaacccgtttaggtcggcgtaggggttcggggtaaccgtaggggtaactaaggtacgggtttaccaaccttcctaccaaacctacgttacccgaaggtacccacggtcccttagggtaccttaaaccggttcgttaaacggtaaacgggtttatttttacgaccttaagggtttacccttaagggtacttaacgttcgttaccgaagtaccgttaaggtttacgtacggggtactaaccgttaaccggaaaacggttccgggttaacccgggaaaccggaaagggggtaaacccgttaaagggttaaaccggggaaaacttaaaccggaaacggttaacgttgggtacggtaaccacggtacttaccgtaacgtttccgttaaccg

SEQ ID NO: 313718 - DNA, 259 bp, Homo sapiens; identical to SEQ ID NO: 313652
  misc_feature: GZ8MTXP01AHC1D.39.71.G05.1.454.CMB.2.raw
  modified_base (256)..(259): a, c, t, g, unknown or other
  misc_feature (256)..(259): n is a, c, g, or t

SEQ ID NO: 313719 - DNA, 742 bp, Homo sapiens
  misc_feature: GZ8MTXP01BN5WN.39.71.G05.1.454.CMB.2.raw
  modified_base (285)..(285): a, c, t, g, unknown or other
  misc_feature (285)..(285): n is a, c, g, or t
  modified_base (517)..(517): a, c, t, g, unknown or other
  misc_feature (517)..(517): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggtcttaatttaaaaggtgtccagtgtgaggtgcagctggttggagtcgtgggggaggtcgttggtacgacgggcccggggggtccctgagtactctcctgtgcagcctgtggattccaccttcagcagctancgccatcgaccgtcggccgcgacggcctacggaagggaagggcgtgggagtgggtctcggttactagtttaggtagggtaagttggtacgtacttaaactaaacccgaaaccgttacgaccgaaccgtccccgttaaccgggttagggaaccgggtcccgtaccttacccgaaccctacttacccgtaccgaagtacgtaactaacttacccgaaagtacgactaaccgttntagtaactctagaacaaatacgaaactcgtaccgtagacggtcgacccgaaggaccgtaaccggtaccctaaagtttagttacggttggtaacggtaaacgggttaaagggttgggggttaggggggtaacggtcgggggttaccttccgggttacccggtttggggtaccggttttaacgtaaccgggtacgggttccggggaaccggttaacggggtccccgg

SEQ ID NO: 313720 - DNA, 701 bp, Homo sapiens
  misc_feature: GZ8MTXP01A1XO7.39.71.G05.1.454.CMB.2.raw
  modified_base (192)..(192): a, c, t, g, unknown or other
  misc_feature (192)..(192): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctccagatatcactggagaaatagtgatgacgcagtctccagccaccctntctgtgtctccaggagaaaagcgcccaccctctcctggtagggccagtcagagttgttagctacaacttagcctggtaccagcaagaaacctggcctaggttccccaggctcatcatctatggtgcatccaccgaggggcccacgtcggttaacctcccgacgtacccctaacccgttttaaagggcgggtcgaacgggttcgggggttccgtacgggggaacctaagggtacgtttacccaacccttcccttaccgaacccctaattcccgaaacggtccaaaccggtccccttaggacccgttaaggttccttaagggttaaacggttttacggttttacgtaacgtttaagtttttaaacgttaccgttacgttaaacctaaacgtaagtaaactaagtcgtactccggtcccttcgttaccgttaccggttcggggaccggggtaacggttaccggaagggttagggaacgtacgtaaacgaaacgtacgttgggtcgcgtaacg

SEQ ID NO: 313721 - DNA, 841 bp, Homo sapiens
  misc_feature: GZ8MTXP01CG2V7.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggcttaattttaaaaggtgtccagtgtgaggtgcagctggttggagtcgtggggggaggtcgttggtacgacgggcccgggggggtccctggacgtactctcctggtcgcacgcctcgtggtacttcctacccttcagcagtctatgaccagtcgaccgtcgggtcccgccgacggccgtaccggaaggggaaaggggtaccgtggggaggttcgggtccttacgttcgttaagtttagggtaggtaaggttgggttgtactttaacgtaaaccccgtaaacgtaccgacgtaaccggtcccggttaacccgggtacgggtaacccgggggtcccgtaacccgtttacccgaacccctacgttaccccgtaaccggtaaacgtaaccgttaacttaaccgttacccgaaaaggtaacccgtaccctaacctttacgtttacgtaacgtttcgaacgtaaacctaaaagttacccgaaacggtacggtcccggttaaggacggggttacccgaaccggaaccgggtaaccgtaaccccggtaacctttagttaaccgtttcggttaggtaacgggtaaacgttaaggggttgggggttaacggggggtaggttcgggggaccgttccggttcggttgggttacggtttaacggacgtacggggcggggtaaccggttgggggtaaccccg

SEQ ID NO: 313722 - DNA, 700 bp, Homo sapiens
  misc_feature: GZ8MTXP01DDZKF.39.71.G05.1.454.CMB.2.raw
  modified_base (195)..(195): a, c, t, g, unknown or other
  misc_feature (195)..(195): n is a, c, g, or t
tcagtcgcactagtcacgaccggtgctcgatttagtgtcgtcgcaagagagaggggggtcaggctggaactgaggagcagggtgggggcacttctccctctaacactctccccagcgcagcttctcttcctcctgctactctggctcccagatatcactggagaaatagtgatgacgcagtctccagccaccctntctgtgtctcaggagaaagcgccacctctcctgtagtcgccagtcagtagttgtagactacaacttagcctaggtaccagacaacgaaacctcggacctacggttccccaggtcctacactcatctagtgggtcactactccaaccggtacgggcctaccgtcggtactcccgacgtcccttaaaccgtttaggcggtacgtagggttcggggtacgtaggggaactaggtaccgttacctactacctaccaaccattaccgacgaccagacccgttgaccgtagttacgtaaggttaagtttacgtttttacggactttaaacggttttacttaacgttcgtaacgtaaacttacggttaaacacgttacggtcgttaaccggtcccttacgttaccgttaccgggtttccgggggaacggggttacggggaacccggttaaggggttaacggaaacgtaacgttaaaccgaaaacgggttacgttaacgggcgggttaacccg

SEQ ID NO: 313723 - DNA, 257 bp, Homo sapiens
  misc_feature: GZ8MTXP01BXRY6.39.71.G05.1.454.CMB.2.raw
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (256)..(257): a, c, t, g, unknown or other
  misc_feature (256)..(257): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggcctgggctgcctggtcaaggactacttccactagtgcgactgaggcggntggacaaggcncatagnn

SEQ ID NO: 313724 - DNA, 680 bp, Homo sapiens
  misc_feature: GZ8MTXP01CM2O9.39.71.G05.1.454.CMB.2.raw
  modified_base (305)..(305): a, c, t, g, unknown or other
  misc_feature (305)..(305): n is a, c, g, or t
  modified_base (503)..(503): a, c, t, g, unknown or other
  misc_feature (503)..(503): n is a, c, g, or t
  modified_base (517)..(517): a, c, t, g, unknown or other
  misc_feature (517)..(517): n is a, c, g, or t
tcagtcgcactagtcacgaccggtgctcgatttagtgtcgtcgcaagagagagggcccagccctgggattttcaggtgttttcatttggtgatcaggactgaacagagagaactcaccatggagtttgggctgagctggctttttctgtggctattttaaaaggtgtccagtgtgaggtgcagctgttggagtcgtgggggaggtcgttggtacgacgggccgggggggtccctggagactctccgtgtgccagcctctggtattccaccttcagcagctatcgccagtcgacccgtgggtcccnccgacggctaccggagggaacgggacgtgggagtcggtctcgtacttagtttagtgggtaacgttggtatacgttaactaacccgtaaacgtacgcgtaacgccccgttacgggacgtaaccggggcctacccttaccaacctataccctacccaaaggactaacttaacgtacccgaaaggcctacaacttccgtanactttcgacgaaanaactacgtacgacgtacgtacgtacgtacgacgacgacgaccgtaccgttactacgttacgttagtaacggtaacggttaggtaggggttacggggtacgggtcgggttcggttcgttcggttcggttcggttaacgtacgtacggttcgggtcggcggtccg

SEQ ID NO: 313725 - DNA, 685 bp, Homo sapiens
  misc_feature: GZ8MTXP01E1OGM.39.71.G05.1.454.CMB.2.raw
  modified_base (261)..(261): a, c, t, g, unknown or other
  misc_feature (261)..(261): n is a, c, g, or t
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
  modified_base (447)..(447): a, c, t, g, unknown or other
  misc_feature (447)..(447): n is a, c, g, or t
  modified_base (673)..(673): a, c, t, g, unknown or other
  misc_feature (673)..(673): n is a, c, g, or t
tcagtcgcactagtcacgaccggtgctcgatttagtgtcgtcgcaagagagaggggcccagccctgggattttcaggtgtccagtgtgaggtgcagctgttggagtctgggggaggcttggtacaggccgggggggtccctgagactctcctgtgcagcctctggattcaccttcagcagctatgccatgacctgggtccgccaggctccgaaggggaaggctggagtgggtctgtctattaggtggaagtggtgtcttanaacaaactcgcagccncggtggaacgggccncttccaccatctccagatactattccaaagacactctctagttactactagaactaaagtacgaaccacgtctaggtagccgaaccgggaacgaaccgacccggtaccttaattacgtttagtgggacgtaagtaaagggtggggtacggggggnggtcggggtaccttacggttccggtgggtttacgttagggtaaccgttcggggtacgggaccgggaagggtcccggggtcccgttacggggttaccctacccggttcctacccgtcgacccggttcccaacccgaccgggtaaccgtccccgtacgttccccggttccccgttcccggcgggcccctcgtaccgccgttacgacgccgccctaaccgacgagaccnccgaacgccggg

SEQ ID NO: 313726 - DNA, 796 bp, Homo sapiens
  misc_feature: GZ8MTXP01CG4WD.39.71.G05.1.454.CMB.2.raw
  modified_base (193)..(193): a, c, t, g, unknown or other
  misc_feature (193)..(193): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggaagaaatgtgatgacgcagtctccagccaccctntctgtgtctacaggagaaagcgccctacctctcctggtacggccagtcagtagttgtagcagactaacttcgcctaggtaaccagacaacggaaaccgtcggaccctacggttcccccaagggtcctacaactactaagttaccgttaagtcgggttacacctaactcccccggaaaccgacgggggtaccctaacccggttcgggtaacctaccccgaacggtaccccttaaaacccggtttttaggccgggtaccgtaagggggtttccgggggttaccgtaacgggggtaacccgtaagggttaacccgtttacctaacccgtttaccctaaacccgaaaccccgttaactacccgaacgttacccgtaaccgccccgttaggacccgtaaggttaccgttaaggtaaacggggtttatttttaccggactttaaggtttaacttaccgtacttaacgtaaactacgtaaacctaaagtttcgaaccttcggtcccttacggttacccttacggtttaccgggacgggttaacggggttacccgttaagggttaacggaaacgtaacgttaaacggaaacgttacgttaagcggtaaccg

SEQ ID NO: 313727 - DNA, 666 bp, Homo sapiens
  misc_feature: GZ8MTXP01CW8ZB.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacgaggccggggggtccctgagactctcctgtgcagcctcgtggattcacccttcagcagctatcgccatcgacctgggtcccgccaggctccgaggggaagggacgtggagtgggtctcgtctagttaggtggaagttggtgtcttaataacccaaacgtacgcgtacgcccgtacccggtagaacggggcccgtccgttccacctactcctaccgaacggacgtaaccttacttacccgaaagacgtacccacgttaccttgtactacgttacgacgtaaaatcggaaacgtacggccccgttaggaacgggttccggacccggaacggacccgtaccgggacccttaaggttattacgttggtaaggaacgttaaaggtgggttaggggggtagtcgggggcttcggttcgtgggttccgttaagcgtacggttcggggcgaaggggtccg

SEQ ID NO: 313728 - DNA, 262 bp, Homo sapiens
  misc_feature: GZ8MTXP01AMPVL.39.71.G05.1.454.CMB.2.raw
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (256)..(262): a, c, t, g, unknown or other
  misc_feature (256)..(262): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggntggcaaggcncatagnnnnnnn

SEQ ID NO: 313729 - DNA, 261 bp, Homo sapiens
  misc_feature: GZ8MTXP01DLW3I.39.71.G05.1.454.CMB.2.raw
  modified_base (257)..(261): a, c, t, g, unknown or other
  misc_feature (257)..(261): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggacaaggcgcatagnnnnn

SEQ ID NO: 313730 - DNA, 751 bp, Homo sapiens
  misc_feature: GZ8MTXP01ANHHZ.39.71.G05.1.454.CMB.2.raw
  modified_base (625)..(625): a, c, t, g, unknown or other
  misc_feature (625)..(625): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggtcttaattttaaaaggtgtccagtgtgaggtgcagctggttggagtcgtgggggaggtcgttggtacgacgggcccgggggggtccctggacgtactctcctgtgcacgtcctcgtggtacttcctaccttcagcagctatcaccagtcgaccgtcgggtcccgccgacggcctaccggaaggggaacgggtcgtggggtacggttcgggtactcgtacgttaagttaggtagggtagttggtagtactttaacgtaacccaaaccgtacgactaccgtcccgttaaccggtaacgggaaccgggtccctacctttacccgaccctaacttccctaccgaaacgtacgtaaccttaaccttaaccgaaagtaccgtacctaacgttctagtacctgttacgaactaaagtcgaaacggacgtccgtagaccggcgaaccgacggaacctaccggtacttagttatttaggngtaacggaaggttaagggtcgggggttagggggtacggttcggggttaccttcggttccgggttgggtttcgtttaaccggacggttaccgggggttcgggggaacccgttaacggggtaaccccg

SEQ ID NO: 313731 - DNA, 576 bp, Homo sapiens
  misc_feature: GZ8MTXP02GX2UG.39.71.G05.1.454.CMB.2.raw
  modified_base (138)..(138): a, c, t, g, unknown or other
  misc_feature (138)..(138): n is a, c, g, or t
  modified_base (280)..(280): a, c, t, g, unknown or other
  misc_feature (280)..(280): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (349)..(350): a, c, t, g, unknown or other
  misc_feature (349)..(350): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
tcagtcgcactagtcacgaccggtgctcgatttagtgtcgtcgcaagagagagggcccagccctgggatttcaggtgtttcatttggtgatcaggactgaacagagagaactcaccatggagtttgggctgagcgtgngtttctagtggctatttaaaggtgtcagtgtgaggtgcagctgttggagtctggggaggcttggtacagccggggggtcctgagactctcctgtgcagcctctggattcaccttcagcagctatagcatgaactggtcgccngctccaggaaggggcgtggagtggtcgtcatccatagtcgtagtagtagttanatatactacncanacnngagaggacgatacacactcncanagacaacgacaacgaacacactagtactactacacaaataacgaacgacgacgtacgagacgacggacggacgacggacgtagtagttagttacgtagtaggtacggtaggttacggttttacgggttttacgggttaggttacggtaaccgttacgttacgttacggtacggtacggggtaccgggtaaccgggtaacccgg

SEQ ID NO: 313732 - DNA, 516 bp, Homo sapiens
  misc_feature: GZ8MTXP02GXBSH.39.71.G05.1.454.CMB.2.raw
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
tcagtcgcactagtcacgaccggtgctcgatttagtgtcgtcgcaagagagagggcccagccctgggatttcaggtgtttcatttggtgatcaggactgaacagagagaactcaccatggagtttgggctgagcgtggcttttctgtggctattttaaaggtgtccagtgtgaggtgcagctgttggagtctggggaggcttggtacagccggggggtccctgagactctcctgtgcagcctctggattcaccttcagcagctatgccatgacctggtccgccaggctccagggaagggactggagtgggtctcgtctattagtggaagtggtgcttataccaaactacgcagcctccgtgagggccgnttcaccatctccagagactattccaagncactctgtatcngacaananacagcngagngcgacgacgacgactatatatagtgagagtaggtggggacgggcggggcgtacgtcgtcggtcgttcgtacgtacgtcggcggacggcg

SEQ ID NO: 313733 - DNA, 490 bp, Homo sapiens
  misc_feature: GZ8MTXP02G2HOG.39.71.G05.1.454.CMB.2.raw
  modified_base (212)..(212): a, c, t, g, unknown or other
  misc_feature (212)..(212): n is a, c, g, or t
  modified_base (342)..(342): a, c, t, g, unknown or other
  misc_feature (342)..(342): n is a, c, g, or t
tcagtcgcactagtcacgaccggtgctcgatttagtgtcgtcgcaagagagaggggtcaggctggaactgaggagcaggtggggcacttctccctctaacactctccccagcgcagcttctcttcctcctgctactctggctcccagatatcactggagaaatagtgatgacgcagtctccagccaccctctctgtgtctccaggagaaagngccacctctcctgtaggccagtcagagtgtagctacaacttagcctggtaccagcagaaacctggccaggttcccaggctcatcatctatggtgcatccacagggccatcggtatcccagccactttagngcagtgggtctgggacagagttcactctcacatcagcagcctgcagtctagagtatttgctagtttattactgtcaacagtacaatgactggcctctctactttcggcggtacggaccaaggtgaagatacgaaacgactgtcggctg

SEQ ID NO: 313734 - DNA, 530 bp, Homo sapiens
  misc_feature: GZ8MTXP02JU78X.39.71.G05.1.454.CMB.2.raw
  modified_base (350)..(350): a, c, t, g, unknown or other
  misc_feature (350)..(350): n is a, c, g, or t
  modified_base (435)..(435): a, c, t, g, unknown or other
  misc_feature (435)..(435): n is a, c, g, or t
  modified_base (467)..(467): a, c, t, g, unknown or other
  misc_feature (467)..(467): n is a, c, g, or t
  modified_base (484)..(484): a, c, t, g, unknown or other
  misc_feature (484)..(484): n is a, c, g, or t
  modified_base (527)..(527): a, c, t, g, unknown or other
  misc_feature (527)..(527): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtggcgttttctaggtggctattttaaaaggtgtcagtgtgaggtgcagctgttggagtctgggggaggcttggtacaggccgggggggtccctggagactctcctgtgcagcctctggattcaccttcagcagctatgccatgacctgggtccgccaggctccagggaagggactggagtgggtctcgtctattagtggaagtggtgcttanacaaactacgcagcctcgtgaagggccgcttcaccatcctccagagactacttccaagagcactctgtatctgacaaatgaaacngactgagtcgacgagacgacgcctatatatgngagaagtgggagggggnggtcggggtctacgtcgtggtcgtttcgacgtcggtcgggcgnggg

SEQ ID NO: 313735 - DNA, 535 bp, Homo sapiens
  misc_feature: GZ8MTXP02I8V7F.39.71.G05.1.454.CMB.2.raw
tcagtcgcactagtcacgaccggtgctcgatttagtgtcgtcgcaagagagaggagcccagccctgggatttcaggtgttttcatttggtgatcaggactgaacagagagaactcaccatggagtttgggctgagctggcttttcttgtggctattttaaaaggtgtccagtgtgaggtgcagctgttggagtctgggggaggcttggtacaggccggggggtccctgagactctcctgtgcagcctctggattcaccttcagcagctatgccatgacctgggtccgccaggctccaggggaaggactggagtgggtctcgtctatagtggaagtggtgcttatacaaactacgcagcctccgtgaaggccgcttcaccatctccagagactattccaagagcactctgtatctgcaaatgaacagcctgagtgccgaggacaacggccctaatattaattgtagcgaaatggttagggggacgtgggggcttacgccgtgggtcgttttagaccgtacgtggggcccaaggggg

SEQ ID NO: 313736 - DNA, 619 bp, Homo sapiens
  misc_feature: GZ8MTXP02F3ESJ.39.71.G05.1.454.CMB.2.raw
  modified_base (247)..(247): a, c, t, g, unknown or other
  misc_feature (247)..(247): n is a, c, g, or t
  modified_base (268)..(269): a, c, t, g, unknown or other
  misc_feature (268)..(269): n is a, c, g, or t
  modified_base (272)..(272): a, c, t, g, unknown or other
  misc_feature (272)..(272): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtgcgtttctaggtggctatttaaaggtgtccagtgtgaggtgcagctgttggagtcgtgggggagcttggtacaggccggggggtcctgagactctcctgtgcagcctntggattcacttcagcagctanncancgcgtcggccgccgcgcgcgaggaggagtggaggtggtcgtcgtcgtagttaggtaggtagtggtgtactactaactaaacgtacgacacgccgtccgtcggacgggccgtccgtaccacctactacctaccacgacgtactactacaacgacgacactactacgtactactacactaaataacgaacgacgtacgtacgtacgtacgacggacggacgaccggtaccgtacgttacgttagttacgtacggtacggtaacggtaggggtacgggggtacggggtacggggtacggtacgtccggttcggttacggttacggtacgtacggtacgggtacggtacgg

SEQ ID NO: 313737 - DNA, 255 bp, Homo sapiens
  misc_feature: GZ8MTXP02GXMX9.39.71.G05.1.454.CMB.2.raw
  modified_base (253)..(255): a, c, t, g, unknown or other
  misc_feature (253)..(255): n is a, c, g, or t
tcagtcgcactagtcacgaccggtgctcgatttagtgtcgtcgcaagagagagggggagtggggctactcctggcgttttaactactggggccagggagccctggtcaccgtctcctcagcctccaccaagggcccatcggtcttcccctggcgccctgctccaggagcacctccgagagcacagcggcctgggctgcctggtcaaggactacttccactagtgcgactgagcgggctggcaaggcgcatagnnn

SEQ ID NO: 313738 - DNA, 499 bp, Homo sapiens
  misc_feature: GZ8MTXP02HGSXE.39.71.G05.1.454.CMB.2.raw
tcagtcgcactagtcacgaccggtgctcgatttagtgtcgtcgcaagagagaggggtcaggctggaactgaggagcaggtggggcacttctccctctaacactctccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcataaacctggccaggttcccaggctcatcatctatggtgcatccacagggccactcggtatcccagccacctttagtggcagtgggtctggggacagagttcactctcaccatcagcagcctgcagtctgaagtatttgctagtttattactgtcaacagtacaatgactggcctctctactttcggcggtagggaccaaggtgaagatacgaaacgactgtacggctg

SEQ ID NO: 313739 - DNA, 540 bp, Homo sapiens
  misc_feature: GZ8MTXP02HA3D5.39.71.G05.1.454.CMB.2.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctatctgtgtctccaggagaaagngccaccctntcctgtagggccagtcagagtgttagctacaacttagcctggtaccagcagaaacctggccaggttcccaggctcatcatctatggtncatcccacgagggccagtcggtactcccagcctactttagngcaggtgggtctggggacagagttcactctcacatcagcacgcctgcagtctagaagtatttgctagtttattactagtacaactagtaacaagtacgtactcggtcctctactacgtttacggacggtacgggaaccgtaagggtacggaagtaacgtaacgaaaacgtaacgtggtacggacgtcg

SEQ ID NO: 313740 - DNA, 531 bp, Homo sapiens
  misc_feature: GZ8MTXP02JWKBF.39.71.G05.1.454.CMB.2.raw
  modified_base (469)..(469): a, c, t, g, unknown or other
  misc_feature (469)..(469): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttctgtggctattttaaaaggtgtccagtgtgaggtgcagctgttggagtctgggggaggcttggtacaggccgggggggtccctggagactctcctgtgcagcctctggattcaccttcagcagctatgccatgacctgggtccgccaggctccgagggaagggctggagtggtctcgtctattagtggaagtggtgcttataccaaactacgcacgcctcgtgagggccgcttcaccatctccagagactatccaagaacactactgtatctagacaaatgaacagcctagacgcgaccgagacacggaccctatattactgncgaaactctcccgatcgtacgttcgccacctaagttcactcgtagggccacgggaccctcgg

SEQ ID NO: 313741 - DNA, 526 bp, Homo sapiens
  misc_feature: GZ8MTXP02I4W04.39.71.G05.1.454.CMB.2.raw
  modified_base (193)..(193): a, c, t, g, unknown or other
  misc_feature (193)..(193): n is a, c, g, or t
  modified_base (353)..(353): a, c, t, g, unknown or other
  misc_feature (353)..(353): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctntctgtgtctccaggagaaagcgccaccctctcctggtacgggccagtcagagtgttagctacaacttagcctggtaccagcagaaacctggccaggttcccaggctcatcatctatggtgcatccaccgagggccatcggtactcccagcctactttagngcagtgggtctggggacagtagttcactctacacatcagcacgcctgccagtctagaagttatttcgacttagtttacttactgtacaactagtacatgactggtccttctctacgttcggacggtacggaccgtaggtgaagtactaacgaaacgacgttggacggtctacg

SEQ ID NO: 313742 - DNA, 601 bp, Homo sapiens
  misc_feature: GZ8MTXP02IHHYH.39.71.G05.1.454.CMB.2.raw
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcggtgtgtttctaggtggctatttaaaggtgtccagtgtgaggtgcagctgttggagtctgggggaggcttggtacagccgggggggtcctgagactctcctgtgcagcctntggattcaccttnagcantatgcatcgcgtcggtccgcgcgcgcgaggaggacgtggaggtggtcgtcgtcgtagtagtaggtaggtagtgtacttataaccaactacgacgacgcgtcgtcgacggccgtctaccacctactctacacgactactactacaacgacgactactcttagtatactacgactaaacgtaacgaacgacgtacgtacgtacgtacgacggacggacgaccgtaccgttattagttagttagtacgtagtaaggtagggtagggggtacggggtacgggtacgtacgttacgtcggttcggtttacgtacgtacggtacgggtacggacggtacgg

SEQ ID NO: 313743 - DNA, 502 bp, Homo sapiens
  misc_feature: GZ8MTXP02I1KWB.39.71.G05.1.454.CMB.2.raw
  modified_base (341)..(341): a, c, t, g, unknown or other
  misc_feature (341)..(341): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccaccagggccactggtatccccagccaccctttagngcagtggtctgggcagagttcactctcaccatcagcagcctgcagtctagaagtatttgctagtttattactgtcaacagtacaatgactggcctctctacgtttcggcggaggaccagggtaggagacgtacaaacgactgtaggctacgcaccatctcg

SEQ ID NO: 313744 - DNA, 532 bp, Homo sapiens
  misc_feature: GZ8MTXP02F2Q5M.39.71.G05.1.454.CMB.2.raw
  modified_base (368)..(368): a, c, t, g, unknown or other
  misc_feature (368)..(368): n is a, c, g, or t
  modified_base (434)..(434): a, c, t, g, unknown or other
  misc_feature (434)..(434): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggaggcttggtacagcctgggggtccctgagactctcctgtgcagcctctggattcacctttagcagctatgccatgagctgggtccgccaggctccgaggggaaggggctggagtgggtctcagctagttagtggtagtggtggtagcacatactacgcagctccgngaagggcccgttcaccatctccagacgacaattccaaagaacacgctgtatctgacaaatgaaacngcctagagacgccgaggaccacggccgtaatactactgtagactaaaattgaaagcgaactgaagtaagtgactcggggcctcgtacgtggggacccg

SEQ ID NO: 313745 - DNA, 519 bp, Homo sapiens
  misc_feature: GZ8MTXP02F4NKS.39.71.G05.1.454.CMB.2.raw
  modified_base (401)..(401): a, c, t, g, unknown or other
  misc_feature (401)..(401): n is a, c, g, or t
  modified_base (444)..(444): a, c, t, g, unknown or other
  misc_feature (444)..(444): n is a, c, g, or t
  modified_base (515)..(515): a, c, t, g, unknown or other
  misc_feature (515)..(515): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagcccaccctctctgtgtctccaggagaaagagccaccctctcctgtagggccagtcagagtgttagctacaacttagcctggtaccagcagaaacctggccaggttcccaggctcatcatctatggtgcatccaccagggccactggtactcccagccaccctttagtggcaggtgggtctgggacagagttcagtctcaccatcagcagcctgcagtctgtaagtntttagtactttattactgtacagctagtatgatacctggcctnactagtttcggacgtagggggacctagggttaggagtacttacgaaacgtaacgtggtggctagcaacctntctg

SEQ ID NO: 313746 - DNA, 556 bp, Homo sapiens
  misc_feature: GZ8MTXP02IV2UL.39.71.G05.1.454.CMB.2.raw
  modified_base (286)..(286): a, c, t, g, unknown or other
  misc_feature (286)..(286): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (378)..(379): a, c, t, g, unknown or other
  misc_feature (378)..(379): n is a, c, g, or t
  modified_base (385)..(385): a, c, t, g, unknown or other
  misc_feature (385)..(385): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtgtcgtttctaggtggctatttaaaggtgtccagtgtgaggtgcagctgttggagtctgggggaggcttggtacaggccgggggggtcctgagactctcctgtgcagcctctggattcaccttcagcagctatgccatgactggtccncaggctccagggagggactggagtgggtctcgtctattagtggaagtggtgcttatacaaactcgcagcctccgngaggggccncttcaccnnctccanagactattaccaagaacacactctgtatctagactaatagaacgacgacgtagagacgacgacgacgacgactattattattgtacgtagtaaggtagggtgggggtagggtacgggtcggtacgtcgtcggttcggttacgtacgtacggtacgggtacggacggtacgg

SEQ ID NO: 313747 - DNA, 667 bp, Homo sapiens
  misc_feature: GZ8MTXP02HNQVP.39.71.G05.1.454.CMB.2.raw
  modified_base (286)..(286): a, c, t, g, unknown or other
  misc_feature (286)..(286): n is a, c, g, or t
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtgcgttttctagtggctattttaaaggtgtccagtgtgaggtgcagctgttggagtctggggaggcttggtacagccgggggggtcctgagactctcctgtgcagcctctggattcaccttcagcagctatgccatgacctgggtccnccaggctccgagggaaggctggagtgggtctcggtctattagnggaagtggtgctttaanaccaaacgtcgcacgtccgtcggtaggacgggcctctccacctactcctacagacgtactacttaccgaagacgacctacttcgtagttactcgtacgtactaaacgtaacgaaacgtaacgtaccgtacggtacggtacggaccggaaccggaaccgtacccggtacccgtaacgttaacgtttaagttaggttacggtaacggtaaaggttacgggggtagggggtacgggggtacgggggtaccggttaccgttaccggttcgggttcggtttacggttacggttaccgggtacggggtaccgggtacggggtaccgg

SEQ ID NO: 313748 - DNA, 604 bp, Homo sapiens
  misc_feature: GZ8MTXP02JZBNF.39.71.G05.1.454.CMB.2.raw
  modified_base (289)..(289): a, c, t, g, unknown or other
  misc_feature (289)..(289): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
tcagtcgcactagtcacgaccggtgctcgatttagtgtcgtcgcaagagagaggggcccagccctgggatttcaggtgtttcatttggtgatcaggactgaacagagagaactcaccatggagtttgggctgagcgtggcgttttctagtggctattttaaaggtgtccagtgtgaggtgcagctgttggagtctgggggaggcttggtacaggccgggggggtccctgagactctcctgtgcagcctctggattcaccttcagcagctatgccatgaccctgggtccnccaggctccgagggaagggactggagtgggtctcggtctattagtggaagtggtgcttataccaaactacgcagcctccgtgagggccgcttcaccatccncaganactatcaagacncactctagtatctacgacaaatagaacacgaccgtagtacggtacgaccgacggaccgaccggacccgtaacttactttagttagtacggtacggtaaaggtaggggtagggggtacgggggtacgggggtacggtacgtccggtcgggttcggtttacggttacggttacggtacggggtaccgggacgggtacgg

SEQ ID NO: 313749 - DNA, 513 bp, Homo sapiens
  misc_feature: GZ8MTXP02GBMUE.39.71.G05.1.454.CMB.2.raw
  modified_base (214)..(214): a, c, t, g, unknown or other
  misc_feature (214)..(214): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (382)..(382): a, c, t, g, unknown or other
  misc_feature (382)..(382): n is a, c, g, or t
  modified_base (429)..(429): a, c, t, g, unknown or other
  misc_feature (429)..(429): n is a, c, g, or t
tcagtcgcactagtcacgaccggtgctcgatttagtgtcgtcgcaagagagagggggtcaggccggaactgaggagcaggtgggggcacttctccctctaacactctccccagcgcagcttctcttcctcctgctactctggctcccagatatcactggagaaatagtgatgacgcagtctccagccaccctctctgtgtctccaggagaaagngcccaccctctcctgtagggccagtcagagtgttagctacaacttagcctggtaccagcagaaacctggccaggttcccaggctcatcatctatgtgcatccacagggccactggtactcccagccacctttagnggcngtgggtctgggacagagttcactctcacntcagcagcctgcagtctgaagtatttgctagtttattactgtacaanagtacaatgactgacctcgtctacgtttcggacggtacggaccgtaaggtggagaagtacgaaacgtacgtcgtaggctagacc

SEQ ID NO: 313750 - DNA, 632 bp, Homo sapiens
  misc_feature: GZ8MTXP02IBZNM.39.71.G05.1.454.CMB.2.raw
  modified_base (291)..(291): a, c, t, g, unknown or other
  misc_feature (291)..(291): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggcttttcttgtggctattttaaaaggtgtccagtgtgaggtgcagctgttggagtcgtggggggaggcttggtacaggccgggggggtccctgagactctcctgtgcagcctctggattcaccttcagcagctatgccatgacctgggtccnccaggctccgaggggaacggctgggagtgggtctcgtctagttagtggaagtgggtgctttatacaaactacgcagccctccgtggaacgggcccgcttccacccatccaccagagactatccaagagcactctgtatctagacaaatagaacacgccgtaggaacgtcggacccggaaggaaccgaccgggtaccccttaattaactttagtttaggtacggtaccggtaaaacggttgggggtacgggggggtacgggttacggggggtccttaaccggtccggttcggggtcggttttttacggaaccgttaccggttcgggggacccgtaacggggg

SEQ ID NO: 313751 - DNA, 590 bp, Homo sapiens
  misc_feature: GZ8MTXP02H0L7H.39.71.G05.1.454.CMB.2.raw
  modified_base (292)..(292): a, c, t, g, unknown or other
  misc_feature (292)..(292): n is a, c, g, or t
  modified_base (394)..(394): a, c, t, g, unknown or other
  misc_feature (394)..(394): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaggtgtccagtgtgaggtgcagctggttggagtcgtgggggaggcttggtacaggccgggggggtccctggagactctcctgtgcagcctctggattcaccttcagcagctatgccatgacctgggtccnccaggcctccgagggaaggctggagtggtctcgtctagttaggtggaagtggtgcttataccaaactcgcacgcctacgtgacggggcctcttccaccatcnccagacgactattaccaagtacgctactctagtactctagactaaaatcgaaacacgtcctaggacggtcgacccgaaggaccgtaccggacccttaatagtttagttagtacgaggtaaaaggtcggggtaggggggagtcgggggacttacgtccgtggtcgttttacgacgtacggtcgggaccgtagggccg

SEQ ID NO: 313752 - DNA, 639 bp, Homo sapiens
  misc_feature: GZ8MTXP02GTFIW.39.71.G05.1.454.CMB.2.raw
  modified_base (316)..(316): a, c, t, g, unknown or other
  misc_feature (316)..(316): n is a, c, g, or t
  modified_base (339)..(339): a, c, t, g, unknown or other
  misc_feature (339)..(339): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccaggagaaagcgcccaccctctcctggtacgggcccagtcagagtgttagctacaacttagcctggtaccagcaagaacctggccaggttcccaggctcatcatctagtggtncatccacgaggccatcggtaccnccacgtcctacgttgcgcgtaggtcgggtcgagggactagtacgttccactcctacacctatcgacgcgacgtccgtgaccgtagttacgtaaggtaagtttagttttcgtactttaagttttacttacgtacgttaaacctaaacgttaacgtaaactaacgttacgtacgttccggttacccttacgttaccggttaccgggtttaccggggaaccggggtaaccggggtaaaccggtaaggggtaacggaaacgtaacgtaaaccggtaaaacggtacgttacggtacggtactacg

SEQ ID NO: 313753 - DNA, 257 bp, Homo sapiens
  misc_feature: GZ8MTXP02HSV4H.39.71.G05.1.454.CMB.2.raw
  modified_base (255)..(257): a, c, t, g, unknown or other
  misc_feature (255)..(257): n is a, c, g, or t
tcagtcgcactagtcacgaccggtgctcgatttagtgtcgtcgcaagagagagggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnn

SEQ ID NO: 313754 - DNA, 543 bp, Homo sapiens
  misc_feature: GZ8MTXP02GVQ1S.39.71.G05.1.454.CMB.2.raw
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtggcttttcttgtggctattttaaaaggtgtccagtgtgaggtgcagctgttggagtctgggggaggcttggtacaggccgggggggtccctgagactctcctgtgcagcctctggattcaccttcagcagctatgccatgacctgggtcccgccaggctccgaggggaaggactggagtgggtctcggtctagttagtggaagtggtgcttatacaaactacgcagccctcgtgaacgggccgcttcaccatctccagagactattccaagagcactctgtatctgacaaatagaacagcctgagtgccgaggacacgcctatattatgtgagtaaagtgggtagggggagtgggggactacgtccgtggtcgttttacgacgtacgtcggggaccgtacgggg

SEQ ID NO: 313755 - DNA, 537 bp, Homo sapiens
  misc_feature: GZ8MTXP02HM7S3.39.71.G05.1.454.CMB.2.raw
  modified_base (204)..(204): a, c, t, g, unknown or other
  misc_feature (204)..(204): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagngccacctctcctgtagggccagtcagagtgttagctacaacttagcctggtaccagcagaaacctggccaggttcccaggctcatcatctatggtgcatccaccagggccacgtggtactcccagccaccctttagngcaggtggtctgggacngagttcagtctcaccatcagcagcctgccagtctgaagtntttgtactttattactgtactagctagtatgatacctggtcctctactacgtttcggaccgtagggggacctagggttggaagtacgttacgaaaaccggagttaaggtcggcgttacggacctaaccttacttcgtcg

SEQ ID NO: 313756 - DNA, 564 bp, Homo sapiens
  misc_feature: GZ8MTXP02GEK14.39.71.G05.1.454.CMB.2.raw
  modified_base (345)..(345): a, c, t, g, unknown or other
  misc_feature (345)..(345): n is a, c, g, or t
  modified_base (395)..(395): a, c, t, g, unknown or other
  misc_feature (395)..(395): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttctgtggctattttaaaggtgtccagtgtgaggtgcagctgttggagtctgggggaggcttggtacaggccggggggtcctgagactctcccgtgcagcctctggattcaccttcagcagctatgccatgaccgtggtccgccaggcctccgagggaaggacgtggaggtgggtctcgtctattaggtggaaggtggtgnttataacaaacctacgcagcctcgtggacgggccgctcaccatctcaganactataccaagacgcactctgtatctagacaaatcgaaacagaccgtgagtcgaccgaaggacaccggtccctaagttattattagtgacgaaagtggggtggggggagtcgggggactaccgtccgtggtcgttttagacgtacggtcggggaccaggggtctcccgg

SEQ ID NO: 313757 - DNA, 500 bp, Homo sapiens
  misc_feature: GZ8MTXP02FWJLQ.39.71.G05.1.454.CMB.2.raw
  modified_base (397)..(397): a, c, t, g, unknown or other
  misc_feature (397)..(397): n is a, c, g, or t
  modified_base (486)..(486): a, c, t, g, unknown or other
  misc_feature (486)..(486): n is a, c, g, or t
  modified_base (500)..(500): a, c, t, g, unknown or other
  misc_feature (500)..(500): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccaccagggccactggtactcccagccacccctttagtgcagtgggtctgggcagagttcactctcaccatcagcagcctgcagtctgaagtntttgctagtttattactgtacaacagtacaatgactggcctctctacgtttcggacggtagggaccaaggtggagatacaaacgactgnggctgcacatcgtn

SEQ ID NO: 313758 - DNA, 565 bp, Homo sapiens
  misc_feature: GZ8MTXP02J222G.39.71.G05.1.454.CMB.2.raw
  modified_base (250)..(250): a, c, t, g, unknown or other
  misc_feature (250)..(250): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (392)..(392): a, c, t, g, unknown or other
  misc_feature (392)..(392): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtgtcgttttctaggtggctattttaaaaggtgtcagtgtgaggtgcagctgttggagtcgtgggggagcttggtacaggccgggggggtcctgagctctcctgtgcagcctntggattcaccttcagcagctatgccatcgacctgggtccgccaggctccgaggggaaggctggagtgggtctcgtntagtgngagtgnctanacancncncncncgngacgcgctcacactcncananactactacaacgancactctatactactagacaaatagaacgacgacgtacgagtacgacggacggacgacgacctactattagttacgtagaggtaacggtagggtagggggtacggggtacggggtacggttaccgttccggttcggttacggtttacggtacggtacggtacgggacggacggg

SEQ ID NO: 313759 - DNA, 591 bp, Homo sapiens
  misc_feature: GZ8MTXP02I08VO.39.71.G05.1.454.CMB.2.raw
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
  modified_base (456)..(456): a, c, t, g, unknown or other
  misc_feature (456)..(456): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtggcttttctgtggctattttaaaggtgtccagtgtgaggtgcagctgttggagtcgtgggggaggcttggtacaggccgggggggtccctgagactctcctgtgcagcctctggattcaccttcagcagctatgccatgacctgggtccgccgaggcctccgaggggaagggactggagtgggtctcggtactatttaggnggaagtggtgacttanacccaaaacgtcgcacggtccctccggtagacgggggccncttcacccattcnccagacncttatcccaaagacgcactctgtactnagacaaatgaacncgtccgtagcgacgacgacgacgacgacctactatagttagtacgtacgtaaggtagggtgggggtaggggtacggggtcgtacgttcggttcggttcggtttacgtacgtacggtcgggtaccggacggtacgg

SEQ ID NO: 313760 - DNA, 574 bp, Homo sapiens
  misc_feature: GZ8MTXP02I7W24.39.71.G05.1.454.CMB.2.raw
  modified_base (291)..(291): a, c, t, g, unknown or other
  misc_feature (291)..(291): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtgtcgtttctagtggctatttaaaggtgtccagtgtgaggtgcagctgttggagtctgggggaggcttggtacagccgggggggtcctgagactctcctgtgcagcctctggatcaccttcagcagctatgccatgacctggtccgccaggcnccacggagggaacgtggagtgggtcgtcgtctattagtggaagtggtggcttatacaaactacgacagctccgttcgagggccggcttcaccaactctccagagactattcccaagaancactctntatctanacaanagaactagtgtagagtacgacgacggacgacgacctatattagttagtacgtagtaaggtaggggtagggggtaggggtacggggtacggtacgtccgtcggttcggtttacggttacgtacggtacgggtacggacgggtacgg

SEQ ID NO: 313761 - DNA, 536 bp, Homo sapiens
  misc_feature: GZ8MTXP02FSQA9.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggagcttggtacagccggggggtccctgagactctcctgtgcagcctctggattcaccttcagcagctatgccatgacctggtccgccaggctccgagggagggactggagtgggtctcgtctattagtggaagtggtgcttataccaaaactacgcagcctccgtgacgggccgcttcaccatctccagacgactattccaagtagcactctgtatctagcaaatgaaacagcctagagtgccgagacacggccctatacttatgtgacgtaaagtggtagggggagtgggggactacgtccgtggtcgtttgacgtagtcggggccagggtacg

SEQ ID NO: 313762 - DNA, 565 bp, Homo sapiens
  misc_feature: GZ8MTXP02G4SIA.39.71.G05.1.454.CMB.2.raw
  modified_base (255)..(255): a, c, t, g, unknown or other
  misc_feature (255)..(255): n is a, c, g, or t
  modified_base (297)..(297): a, c, t, g, unknown or other
  misc_feature (297)..(297): n is a, c, g, or t
  modified_base (393)..(393): a, c, t, g, unknown or other
  misc_feature (393)..(393): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtggtcgttttctaggtggctaattttaaaaggtgtccagtgtgaggtgcagctgttggagtctgggggaggcttggtacaggccgggggggtccctgagactctcctgtgcagcctntggattcaccttcagcagctatgccatcgacctggggtcccnccaggcctccgaggggaagggctgggagtgggtctcggtctattggtggaagttggtgtcttaatacaaaactcgcagccctcgtggaacgggccncttcacctatctccagacactataccaagacncactntntntctananaananacacgcagagcgcgacgacgacgacctactattagtacgtagagtaaggtagggtagggggtacgggtcgggtcgtacgtcgtcggttcggttacgtacgtacggtacgggacggacgg

SEQ ID NO: 313763 - DNA, 256 bp, Homo sapiens
  misc_feature: GZ8MTXP02FR8IZ.39.71.G05.1.454.CMB.2.raw
  modified_base (255)..(256): a, c, t, g, unknown or other
  misc_feature (255)..(256): n is a, c, g, or t
tcagtcgcactagtcacgaccggtgctcgatttagtgtcgtcgcaagagagagggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnn

SEQ ID NO: 313764 - DNA, 255 bp, Homo sapiens
  misc_feature: GZ8MTXP02GWCUQ.39.71.G05.1.454.CMB.2.raw
  modified_base (254)..(255): a, c, t, g, unknown or other
  misc_feature (254)..(255): n is a, c, g, or t
tcagtcgcactagtcacgaccggtgctcgatttagtgtcgtcgcaagagagagggggagtgggggctactcctggcgttttaactactgggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnn

SEQ ID NO: 313765 - DNA, 562 bp, Homo sapiens
  misc_feature: GZ8MTXP02JMQOC.39.71.G05.1.454.CMB.2.raw
  modified_base (378)..(378): a, c, t, g, unknown or other
  misc_feature (378)..(378): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggaggcttggtacaggccgggggggtccctgagactctcctgtgcagcctctggattcaccttcagcagctatgccatgacctgggtccgcaggctccgaggggagggctggagtgggtctcgtctagttagtggaagtggtgcttagtacaaactcgcagccctccgtgaacgggcncgttcaccatcctccagacgactattaccaagagcactctagtatctgacaaatgaaacagcctagagtgaccgaggaccacggaccctagtacttattcggtagacggtaaaagtggggtagggggtacggtacgggggctacgtccgtggtcgttttgacgtacgtcggggccgtaacgggg

SEQ ID NO: 313766 - DNA, 529 bp, Homo sapiens
  misc_feature: GZ8MTXP02I5ZQM.39.71.G05.1.454.CMB.2.raw
  modified_base (348)..(348): a, c, t, g, unknown or other
  misc_feature (348)..(348): n is a, c, g, or t
  modified_base (377)..(377): a, c, t, g, unknown or other
  misc_feature (377)..(377): n is a, c, g, or t
  modified_base (469)..(469): a, c, t, g, unknown or other
  misc_feature (469)..(469): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggcttttctgtggctattttaaaggtgtccagtgtgaggtgcagctgttggagtctgggggaggcttggtacaggccgggggggtccctgagactctcctgtgcagcctctggattcaccttcagcagctatgccatgacctgggtcccgccaggcctccgagggaagggactggagtgggtctcgtctattagtggaagtggtgcttanaccaaactcgcagcctccgtgaggggccncttcaccatctccagagactattccaagagcactctgtatctgcaaatgaacacgtcctgagtgaccgagacacggccctatattattgtancgaaagtggtagggggacgtgggggctacgtcgtggtcgttgactgtcgggccgaggtcg

SEQ ID NO: 313767 - DNA, 554 bp, Homo sapiens
  misc_feature: GZ8MTXP02GJM4M.39.71.G05.1.454.CMB.2.raw
  modified_base (289)..(289): a, c, t, g, unknown or other
  misc_feature (289)..(289): n is a, c, g, or t
  modified_base (348)..(348): a, c, t, g, unknown or other
  misc_feature (348)..(348): n is a, c, g, or t
  modified_base (377)..(377): a, c, t, g, unknown or other
  misc_feature (377)..(377): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggcttttcttgtggctattttaaaaggtgtccagtgtgaggtgcagctgttggagtctgggggaggcttggtacaggccgggggggtccctgagactctcctgtgcagcctctggattcaccttcagcagctatgccatgacctgggtccnccaggctccgagggagggactggagtgggtctcgtctattaggtggaagtggtgcttanaccaaactcgcacgcctccgtgagggccncttcaccatctccagagactattaccaagagcactcctgtactctgacaaatagaaacacgcctagaggtgaccgaggacacggtaccctatattaattgtagacgaaagtgggtagggggtagtcgggggactcgtccgtggtcgtttacgacgtacgtcggggccgagggtaccg

SEQ ID NO: 313768 - DNA, 614 bp, Homo sapiens
  misc_feature: GZ8MTXP02JD9YX.39.71.G05.1.454.CMB.2.raw
  modified_base (297)..(297): a, c, t, g, unknown or other
  misc_feature (297)..(297): n is a, c, g, or t
  modified_base (494)..(494): a, c, t, g, unknown or other
  misc_feature (494)..(494): n is a, c, g, or t
  modified_base (523)..(523): a, c, t, g, unknown or other
  misc_feature (523)..(523): n is a, c, g, or t
  modified_base (534)..(534): a, c, t, g, unknown or other
  misc_feature (534)..(534): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggcttattttaaaaggtgtccagtgtgaggtgcagctggttggagtcgtgggggaggcgttggtacgaggccggggggtcctgagactctcctgtgcagcctcgtggattcaccttcagtagctatagcatgaacgtgggtcccncgaggctaccggaggggaagggcgtgggaggtgggtcctcgactcctagttagtcggtaagtagtagttacataactactacgacaacgactcgaagtggaacggggccgtaattaccaccctaatcctaccgaaagacaaccaaacgacccaaaagaaccctcaacttgtaactctagaactaaaagtcgaaaacncgcctaggacgacgaccgaggaccacggntgtagtatcgngtgacgtaggtttcggtttttcgggttgacgtcgacttaagtacgaacgtacgggtacgggaccgtaacgggtacctcgg

SEQ ID NO: 313769 - DNA, 542 bp, Homo sapiens
  misc_feature: GZ8MTXP02GKMQB.39.71.G05.1.454.CMB.2.raw
  modified_base (290)..(290): a, c, t, g, unknown or other
  misc_feature (290)..(290): n is a, c, g, or t
  modified_base (377)..(377): a, c, t, g, unknown or other
  misc_feature (377)..(377): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggcttttcttgtggctattttaaaaggtgtccagtgtgaggtgcagctgttggagtctgggggaggcttggtacaggccgggggggtccctggagactctcctgtgcagcctctggattcaccttcagcagctatgccatgacctgggtccnccaggctccaggggaaggctgggagtggggtctcgtctagtagtggaagtggtgcttatacaaactcgcagcctcgtgaacgggccncttccaccatcctcccagagactattccaagagcacttctgtatctgacaaatgaacagcctagagcgtccgaggacacggccctatacttattgtgacgtaaatgggtagggggagtcgggggctacgtcgtcggtcgtttgacgtacgtcggggtacacgggg

SEQ ID NO: 313770 - DNA, 534 bp, Homo sapiens
  misc_feature: GZ8MTXP02H3FQ4.39.71.G05.1.454.CMB.2.raw
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggcttttcttgtggctattttaaaggtgtccagtgtgaggtgcagctgttggagtcgtgggggaggcttggtacaggccggggggtccctggagactctcctgtgcagcctctggattcaccttcagcagctatgccatgacctgggtccgccaggcctcgagggaagggctggagtgggtctcgtctagttaggtggagtggtgcttataccaaactcgcagcctcgngagggccntcacntcncaganactatcaagagcactctgtatctagacaaatgaaacagcctagagtgccgaggaccacggcccttaagtattagttgtgacggtaaatgggtagggggagtcgggggctacgtccgtggtcgtttgacgtacgtcgggccgaggcg

SEQ ID NO: 313771 - DNA, 604 bp, Homo sapiens
  misc_feature: GZ8MTXP02H4ETK.39.71.G05.1.454.CMB.2.raw
  modified_base (313)..(313): a, c, t, g, unknown or other
  misc_feature (313)..(313): n is a, c, g, or t
tcagtcgcactagtcacgaccggtgctcgatttagtgtcgtcgcaagagagagggggtcaggctggaactgaggagcagggtgggggcacttctccctctaacactctccccagcgcagcttctcttcctcctgctactctggctccagatatcactggagaaatagtgatgacgcagtctccagccacctctctgtcgtctccaggagaaagcgccaccctctccgtggtagggccagtcagagtgttagctacaacttagctaggtacagcaagaaacctggcctaggtccaggctcatcatctagtggtnctactccaccgagggcctacgtcggtactcccgacgcccttacgtttaggcggcgtagggttcgggtcgtaggggactaggacgtttaccacttctaccactactcaacgtcgacgcctcgacgacgccgttaaggtaagttattttacgactttaaacttacttactacgaaccctaataagtaacttaactttaccttaccgttaacttacgtttcggaccgtaacggggtaccaaacggtcgtacggacgactaaccgaaacgtaaccgtggtacgcgtacgacaccg

SEQ ID NO: 313772 - DNA, 575 bp, Homo sapiens
  misc_feature: GZ8MTXP02GRG7U.39.71.G05.1.454.CMB.2.raw
  modified_base (141)..(141): a, c, t, g, unknown or other
  misc_feature (141)..(141): n is a, c, g, or t
  modified_base (195)..(195): a, c, t, g, unknown or other
  misc_feature (195)..(195): n is a, c, g, or t
  modified_base (268)..(269): a, c, t, g, unknown or other
  misc_feature (268)..(269): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (391)..(391): a, c, t, g, unknown or other
  misc_feature (391)..(391): n is a, c, g, or t
  modified_base (433)..(433): a, c, t, g, unknown or other
  misc_feature (433)..(433): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtgngttttctagtggctattttaaaaggtgtcagtgtgaggtgcagctgttggagtntggggagcttggtacagccggggggtccctgagactctcctgtgcagcctctggattcaccttcagcagctanncntcgcgtcggccncgngcacgaggaggngtggagtgtctcgtntagtagtggagtgtntactanaaccaacgtcgcgacgtccgtcggtaggacgggcctctaccgacctactccacgaanacgactactacaacgacactactactactatactagacaaanacgaacacgacgagacgacgaccgacgacgaccgtacctactattagtagtacgtagtaggtagggtaggggtacgggtacgggtacgtacgttacgtcggttacggttacgtacgtacggtacgggtacggtacggtacgg

SEQ ID NO: 313773 - DNA, 546 bp, Homo sapiens
  misc_feature: GZ8MTXP02IUEKZ.39.71.G05.1.454.CMB.2.raw
  modified_base (280)..(280): a, c, t, g, unknown or other
  misc_feature (280)..(280): n is a, c, g, or t
  modified_base (344)..(344): a, c, t, g, unknown or other
  misc_feature (344)..(344): n is a, c, g, or t
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtgcgtttctaggtggctattttaaaggtgtccagtgtgaggtgcagctgttggagtcgtgggggaggcttggtacaggccgggggggtcctggagactctcctgtgcagcctctggattctaccttcagcagctatgccatncctggtccgccaggctccagggagggacgtggagtggtcgtcggtctattagtggaagtggtgntatacaactacgcagcctcgtgaagggccggcttccaccactctcccagagactacttccaagaancactctgtatctacganaatanaacacgacgtagagcgcgacggacgacgtactactattagttgtagagtagtagggtaggggtcgggtcgggtcgtacgtcgtcggtcgttcgtacgtacggtcggacggacgg

SEQ ID NO: 313774 - DNA, 584 bp, Homo sapiens
  misc_feature: GZ8MTXP02IJ2Y8.39.71.G05.1.454.CMB.2.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (300)..(300): a, c, t, g, unknown or other
  misc_feature (300)..(300): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagngccaccctntcctgtagggccagtcagngtgtagctacaacttagcctggtaccagcagaaacctggccaggtcccaggctcatcatctagtggtncatccacgagggcccatggtactcccagcctacccctttagcggcaggtgggtctggggacagagttcactcctcaccatcagcacgcctgacctagtctagtaaagtatttcgacttaagttttattacgttgttacaaacgtagtaacaagttcgaacgtcggcccttacgtacctaacgtttcggggacgggaacgggtaaccgaaagggttaggaacggtaactaccgtaaaaaccggaagtcggtacgggactacggacctaccctaagtttccgtcgg

SEQ ID NO: 313775 - DNA, 531 bp, Homo sapiens
  misc_feature: GZ8MTXP02IQF32.39.71.G05.1.454.CMB.2.raw
  modified_base (287)..(287): a, c, t, g, unknown or other
  misc_feature (287)..(287): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggcttttctgtggctattttaaaggtgtccagtgtgaggtgcagctgttggagtcgtgggggaggcttggtacaggcccggggggtcctgagactctcctgtgcagcctctggattcaccttcagcagctatgccatgacctgggtccncaggctcgagggaggctggagtggtctcgtctagttagtggaagtggtgcttanaccaaactcgcagcctcgngacgggccnctcaccatctccagagactattcaagagcactctgtatctgacaaatgaacagcctgagtcgccgagacacggacctattactattgtagacgtaaagtgggtagggggagtcgggggactacgtcgtggtcgtttacgactacggtcgggacgagggtacg

SEQ ID NO: 313776 - DNA, 588 bp, Homo sapiens
  misc_feature: GZ8MTXP02JUY5I.39.71.G05.1.454.CMB.2.raw
  modified_base (381)..(381): a, c, t, g, unknown or other
  misc_feature (381)..(381): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagccggcttttcttgtggctattttaaaaggtgtccagtgtgaggtgcagctgttggagtctgggggaggcttggtacaggccggggggtccctgagactctcctgtgcagcctctggattcaccttcagcagctatgccatgacctgggtcccgccaggctaccgaggggaaggacgtggaggtgggtctcgtctagttagtggaagtggtgtctatacaaaccgtcgcagcctcatgacgggccncttcaccatcctaccagacgactacttacccaaagacgccactcctagtaactcctagacaaaatgaaacacgcctaggaggtgacccggaggaccgaccggccctagttacttagtagtacggacgtaaagtggggtaggggggaggtcgggggactacgtccggtggtccggttttagacgtacggtcggggtccgacggggccg

SEQ ID NO: 313777 - DNA, 515 bp, Homo sapiens
  misc_feature: GZ8MTXP02I1FG3.39.71.G05.1.454.CMB.2.raw
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
  modified_base (352)..(352): a, c, t, g, unknown or other
  misc_feature (352)..(352): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctntctgtgtctccaggagaaagagcccaccctntcctgtagggccagtcagagtgttagctacaacttagcctggtaccagcaagaaacctggccaggttcccaggctcatcatctatggtgcatccaccagggccactggtactcccagcctactttagngcagtgggtctgggacagagttcactctcaccatcagcagcctgcagtctagaagtattttgctagtttattactgtacaactagtaacaatgactcggctcgtactacgtttcggcggtacgggaccaaggtacggaagatacgaaacgatacgtcgctacg

SEQ ID NO: 313778 - DNA, 550 bp, Homo sapiens
  misc_feature: GZ8MTXP02GGL38.39.71.G05.1.454.CMB.2.raw
  modified_base (289)..(289): a, c, t, g, unknown or other
  misc_feature (289)..(289): n is a, c, g, or t
  modified_base (380)..(380): a, c, t, g, unknown or other
  misc_feature (380)..(380): n is a, c, g, or t
tcagtcgcactagtcacgaccggtgctcgatttagtgtcgtcgcaagagagaggggcccagccctgggattttcaggtgtttcatttggtgatcaggactgaacagagagaactcaccatggagtttgggctgagctggcttttcttgtggctattttaaaggtgtccagtgtgaggtgcagctgttggagtcgtgggggaggcttggtacaggccggggggtccctggagactctcctgtgcagcctctggattcaccttcagcagctatgccatgacctgggtcccnccaggctccgagggaagggactggagtggtctcgtctattagtggaagtggtgctttaataccaaactacgcagccctccgtgaggggccncttcaccatctcagagactatccaaagagcactctgtaatctagcaaatgaaacagcctgagtgaccgaggacacggccctatacgttatgtagcgaaagtgggtaggggggacgtgggggcctacgtccgtgggtccgttttgaccgtagtcgggggccaggggtaccg

SEQ ID NO: 313779 - DNA, 574 bp, Homo sapiens
  misc_feature: GZ8MTXP02G0KRH.39.71.G05.1.454.CMB.2.raw
  modified_base (303)..(303): a, c, t, g, unknown or other
  misc_feature (303)..(303): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagagcccaccctctcctggtagggccagtcagagtgttagctacaacttgcctggtaccagcagaaacctggccaggttccccaggctcatcatctatggtncatccaccgagggccacgtcggtactccccagccctacctttagtcggactaggtggggtcctggggacctagtagttccactcgtacaccatcagcagcctagctagtctagtaagtattttgacttagtttattactgtacaatagtaacaattcgacttcggccttctacgttacgtttacgggacgggtagggtacccgaaggggtcggaacgtacgtaaccgaaaacggtacgtggtaggaccttacggacctacctatccgttcg

SEQ ID NO: 313780 - DNA, 611 bp, Homo sapiens
  misc_feature: GZ8MTXP02I2MBX.39.71.G05.1.454.CMB.2.raw
  modified_base (214)..(214): a, c, t, g, unknown or other
  misc_feature (214)..(214): n is a, c, g, or t
  modified_base (385)..(385): a, c, t, g, unknown or other
  misc_feature (385)..(385): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccaggagaaagngccacctctcctgtagggccagtcagagtgttagctacaacttagcctggtaccagcagaaacctggccaggttcccaggctcatcatctatggtgcatcccacagggccactcggtactccccgacaggttcagttggcagtgggtctggggacagacttcactctcacntcagcagcctagcagcctagaagtattttcgactaaactttactatttcgtactaaacgtacggtaccttaaacgtacggtttaccccgaacgggttaaccggtttaccgggacccgtaaaacgggggtaaacccgaaaagggggttacgggtaaaaaactaccgaaaaacggtaaaacccgttagggttacggacccgttaggaccaaaccccgtaagtttcccg

SEQ ID NO: 313781 - DNA, 542 bp, Homo sapiens
  misc_feature: GZ8MTXP02J22FC.39.71.G05.1.454.CMB.2.raw
  modified_base (286)..(286): a, c, t, g, unknown or other
  misc_feature (286)..(286): n is a, c, g, or t
  modified_base (376)..(376): a, c, t, g, unknown or other
  misc_feature (376)..(376): n is a, c, g, or t
  modified_base (413)..(413): a, c, t, g, unknown or other
  misc_feature (413)..(413): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggcttttcttgtggctattttaaaaggtgtccagtgtgaggtgcagctgttggagtctggggagcttggtacaggccggggggtccctgagactctcctgtgcagcctctggattcaccttcagcagctatgccatgacctgggtccnccaggctccgagggaagggactggagtgggtctcggtctattagtggaagtggtgcttatacccaaactcgcagcctccgtgacgggccncttcacatctccagagactattcccaagcgcacgtcngtatcctgacaatagacagcctgagtagcgacggacgacggccgtactataattgtgacgaagtaggtaggggtagggtcggggcgtacgtcgtcggtcgttcgtacgtacgtcgggacggacggccgg

SEQ ID NO: 313782 - DNA, 520 bp, Homo sapiens
  misc_feature: GZ8MTXP02F8BCC.39.71.G05.1.454.CMB.2.raw
  modified_base (193)..(193): a, c, t, g, unknown or other
  misc_feature (193)..(193): n is a, c, g, or t
  modified_base (214)..(214): a, c, t, g, unknown or other
  misc_feature (214)..(214): n is a, c, g, or t
  modified_base (313)..(313): a, c, t, g, unknown or other
  misc_feature (313)..(313): n is a, c, g, or t
  modified_base (352)..(352): a, c, t, g, unknown or other
  misc_feature (352)..(352): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctntctgtgtctccaggagaaagngccaccctctcctgtagggccagtcagagtgttagctacaacttagcctggtaccagcaagaaacctggccaggttccccaggctcatcatctatggtncatccaccagggccatcggtactcccagcctactttagnggcagtgggtctgggacagtagttcactctcacatcagcagcctgcagtctagaagtatttgctagtttattactgtacaactagtaacatagactcggacctctctacgttcggcggacgggaccgaaggtacggaagacgtacgaaaacgacgtggtacgcgtacg

SEQ ID NO: 313783 - DNA, 699 bp, Homo sapiens
  misc_feature: GZ8MTXP02H4HLH.39.71.G05.1.454.CMB.2.raw
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctcaggagaaagcgccaccctctcctggtacggccagtcagagtgttagctacaacttagcctaggtaccagacaacgaaaccgtggacctacggttcccaggctcatcatctagtggtgctatccaaccgagggccacgtcggtactccccgagccctaccgtttaggcgcgtaggttggggtccgtggggactaggacgttcactctacaccatccaaccgacgcccgtggcccggtaccttagaaacgttacgtttttacgaccttaaaacttttatttaaccgtacgttaaccctaaaatttaaactttttaaacttttaccttaacgttccccgtacttaccgttaaaccggtttttccgggggaaccggggttaaacggggaaacccgttaaaagggggttacggggaaaacgtaaaccgtttaaccggaaaaaaccggttaaccgttagggtacgggtacctttacggaccccgtaacccttaagtttcccg

SEQ ID NO: 313784 - DNA, 666 bp, Homo sapiens
  misc_feature: GZ8MTXP02HITT4.39.71.G05.1.454.CMB.2.raw
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
  modified_base (422)..(422): a, c, t, g, unknown or other
  misc_feature (422)..(422): n is a, c, g, or t
tcagtcgcactagtcacgaccggtgctcgatttagtgtcgtcgcaagagagaggggcccagccctgggattttcaggtgtttcatttggtgatcaggactgaacagagagaactcaccatggagtttgggctgagcgtggcgttttctagtggctatttaaaggtgtcagtgtgaggtgcagctgttggagtctgggggaggcttggtacagccgggggggtcctgagactctcctgtgcagcctctggattcaccttcagcagctatgccatgacctggggtcccncgagcncgagggaggcgtggagtggtctcgtctagttaggtggtagtggtgtacttanaaccaaactacgcacgtccgtacggaggacgggcctcttccacctatccgtacgagacgtactactaccgaaggacnctacttcgtagttactcgtagtaactaaactaacgaacgacgtaccgtacggtacggtaccggaccggaacgggaaccgaacccggtacccgttaacgttaacgtttacgttacggttacggtacggtaaagggttacgggggtaggggggtacgggggtacgggggtaccggttaccggttccggttcgggttcggtttacggttacggtaccgggtaccggggtaccgggtacggggtacgg

SEQ ID NO: 313785 - DNA, 527 bp, Homo sapiens
  misc_feature: GZ8MTXP02HONAP.39.71.G05.1.454.CMB.2.raw
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (330)..(330): a, c, t, g, unknown or other
  misc_feature (330)..(330): n is a, c, g, or t
  modified_base (338)..(338): a, c, t, g, unknown or other
  misc_feature (338)..(338): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtggtctttttctgtggcttaattttaaaaggtgtccagtgtgaggtgcagctgttggagtcgtgggggaggcttggtacaggccgggggggtcctggagactctcctgtgcagcctntggattcaccttcancagctatgccatcgacctggtcccgcaggctccgaggggaaggactggagtgggctcgtntagttagnggaaagtggtgacttataacaaactcgcagcctcggtgaacgggcctcttcacatctccagacactatccaaagngacaccttntnatcaganaananacancagagcgacgacgacgacgactatatatgtagagagaggagggaggtcggtcgtacgtcgtcgtcgtcgtacgtacgtcggacgacg

SEQ ID NO: 313786 - DNA, 530 bp, Homo sapiens
  misc_feature: GZ8MTXP02IODCV.39.71.G05.1.454.CMB.2.raw
  modified_base (184)..(184): a, c, t, g, unknown or other
  misc_feature (184)..(184): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggcctcccagatatcactggagaaatagtgatgacgcagtctccagccaccctntctgtgtctccaggagaaagacgccaccctctcctggtacgggccagtcagagtgttagctacaacttgcctggtaccagcagaaacctggccaggttcccaggctcatcatctatggtncactccaccgagggccacgtcggtactcccagtcctaccctttagnggctaggtgggtctgggacagagttcactctcaccatcagcagcctgcagtctagaagttatttgcttagtttatactcgtacaactagtaacatcgactggcctctctacgttcggacggtagggaccaaaggggtgaagactaacgaaacgtaactggtcggctcgacaccatcttcg

SEQ ID NO: 313787 - DNA, 549 bp, Homo sapiens
  misc_feature: GZ8MTXP02F6EF9.39.71.G05.1.454.CMB.2.raw
  modified_base (348)..(348): a, c, t, g, unknown or other
  misc_feature (348)..(348): n is a, c, g, or t
  modified_base (411)..(411): a, c, t, g, unknown or other
  misc_feature (411)..(411): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggcttattttaaaaggtgtccagtgtgaggtgcagctgttggagtcgtgggggagcttggtacaggccggggggtcctgagactctcctgtgcagcctctggattcaccttcagcagctatgccatgacctgggtccgccaggcctccgagggagggactggagtgggtctcgtctattagtggaagtggtgcttanaccaaactacgcagccctccgtgacggggccgcttcaccatctccagagactattccaaagancactctgtatctagacaaaatgaaacacgcctagagtgaccgaggacacggaccctatattattgtagacgaaagtggtagggggagtcgggggtctacgtccgtggtcgtttgacgtacgtcggggcagggtaccgg

SEQ ID NO: 313788 - DNA, 611 bp, Homo sapiens
  misc_feature: GZ8MTXP02JTK65.39.71.G05.1.454.CMB.2.raw
  modified_base (361)..(361): a, c, t, g, unknown or other
  misc_feature (361)..(361): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagcccaccctctctgtgtctccaggagaaagcgcccaccctctcctgtagggccagtcagagtgttagctacaacttagcctggtaccagcagaaacctggccaggttcccaggctcatcatctatggtgcatcccaccgagggcctacgtcggtactccccgagccctacgtttagnggccgtagggtggggtcgtaggggactaggtacgttccactcctaccacccgatccagccacgccctgctacgtcgtagtaagttacttttggaccttagttttacttacgttcgtaactaaaccgtagtaaccgtaaatcggtaacgtcggtcccttacgtccttaacggtttccggggacgggtacgggaaccgtaaggggtacggaagtaacgttaacgaaaacggtacgttggtacggacgtaacg

SEQ ID NO: 313789 - DNA, 561 bp, Homo sapiens
  misc_feature: GZ8MTXP02IYQ4Z.39.71.G05.1.454.CMB.2.raw
  modified_base (193)..(193): a, c, t, g, unknown or other
  misc_feature (193)..(193): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (310)..(310): a, c, t, g, unknown or other
  misc_feature (310)..(310): n is a, c, g, or t
  modified_base (369)..(369): a, c, t, g, unknown or other
  misc_feature (369)..(369): n is a, c, g, or t
  modified_base (411)..(411): a, c, t, g, unknown or other
  misc_feature (411)..(411): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctntctgtgtctccaggagaaagngccaccctntcctgtacggccagtcagagtgttagctacacttagcctggtaccagcagaaacctggccaggttcccaggctcatcatctatggtncatccacagggccacgtggtactcccagcctactttagcgcagtggtctaggggacagngttcacgtctcaccatcagctacgcctgccagtctagaagtntttgctaagttttatacgtagtaccaaagtacgtaacagttcgaacgtcgtaccttcgtacctacggtttccgggacggtaaccggggtaacctaagggttcggaacgtaacttaaccgaaaaccggtaacgtcggttacggacttacgg

SEQ ID NO: 313790 - DNA, 590 bp, Homo sapiens
  misc_feature: GZ8MTXP02HYJ3Y.39.71.G05.1.454.CMB.2.raw
  modified_base (292)..(292): a, c, t, g, unknown or other
  misc_feature (292)..(292): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccgggggggtcctggagactctcctgtgcagcctctggattcaccttcagcagctatgccatcgacctgggtccnccaggctccgaggggaaggctggagtgggtctcggtctagttagnggaagtgggtntacttanaacaaacgtacgcacgcccttcggtgaacggggcccacttccgaccatcctaccagagactacttaccaagagacactctgtatctgactaaatagaacagcctaggagtcgacgacggaccgacggaccctatacttagttgtaggacgtaaagtggggtagggggtagggtcgggggtactacgtccgttcgggtcggttttacgacgttacggtcggggaccggaacggggg

SEQ ID NO: 313791 - DNA, 635 bp, Homo sapiens
  misc_feature: GZ8MTXP02HT3MU.39.71.G05.1.454.CMB.2.raw
  modified_base (369)..(369): a, c, t, g, unknown or other
  misc_feature (369)..(369): n is a, c, g, or t
  modified_base (404)..(404): a, c, t, g, unknown or other
  misc_feature (404)..(404): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctggttggagtcgtgggggaggcttggtacaggccgggggggtccctggagactctcctgtgcagcctctggtattcaccttcagcagctatcgccagtcgaccgtgggtccgccgaggcctaccgaaggggaacggacgtggagtgggtctcggtactagtaggtggaagtggtgactttaanaacctaaactacgcacgtcctccggagacgggccncttccaccatcctaccagacgacctaatcccaaagcgacctactctagtactctagtacaaaatcgaaacacgtcctaggacggtcgaccgaacgggaccaacccggcccttaatacgtttagtggtacgacgtaaaggtggggtacggggggaggttcgggggacttaccgtccggtaacggttacggttttacgaccggtttacggcgggggtacccgtagggtcccgg

SEQ ID NO: 313792 - DNA, 580 bp, Homo sapiens
  misc_feature: GZ8MTXP02F1LSN.39.71.G05.1.454.CMB.2.raw
  modified_base (302)..(302): a, c, t, g, unknown or other
  misc_feature (302)..(302): n is a, c, g, or t
  modified_base (422)..(422): a, c, t, g, unknown or other
  misc_feature (422)..(422): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagcccaccctctctgtgtctccaggagaaagcgccaccctctcctgtagggccagtcagagtgttagctacaacttagcctggtaccagcagaaacctggccaggttcccaggctcatcatctatggtncatcccacgagggccacgtggtactcccagtcctacccttttaggcgctaggtgggtctaggggacagtacgttcaccgttctcaccatcagccacgcctggctagtctagtaaacgttntttagactttaagtttacttacgttagtacctaacgtaagttaaccaagttacgacgttcggtaccttcgtacgttacgtttcggggacgggtaacggaccgtaagggtagaagtactaacgaaacgtacgtggtacggctcgactactactcgttcg

SEQ ID NO: 313793 - DNA, 544 bp, Homo sapiens
  misc_feature: GZ8MTXP02GM9N7.39.71.G05.1.454.CMB.2.raw
  modified_base (215)..(215): a, c, t, g, unknown or other
  misc_feature (215)..(215): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagcccaccctctctgtgtctccaggagaaagngccaccctctcctgtagggccagtcagagtgttagctacaactagcctggtaccagcaataaacctggccaggttccccaggctcatcatctatggtgcatcccaccgagggcctacgtcggtactccccagccctacgtttagcggcaggtgggtctgggacagtagttcactctcaccatcagcacgcctgcagtctagaagtattttgacttagttttatactgtacaaagtagtaacaagtgacgtcgtccttctcgtacgtttcgggacggtacggtaccgaagggtggaagtaactacgaaaacgtacgtggtacggtctacg

SEQ ID NO: 313794 - DNA, 642 bp, Homo sapiens
  misc_feature: GZ8MTXP02GLG1B.39.71.G05.1.454.CMB.2.raw
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggagcttggtacaggccggggggtcctgagactctcctgtgcagcctctggacttcaccttcagcagctatgccatcgaccgtggggtcccgccgaggcctcccgaaggggaagggacctgggaggtgggtctcgtctagttaggtggaagttggtgtactttaacgtacaaaactcgctacgccccttcggtggaacggggcccgtactttccgaacccattcctaccaagacgtaactacttaccgaaagacgacacttctagtactctagaactaaatacgaaacacgcctaggacgtcgaccggaggaccgacggtaccctattagttagttaggtacgtacggtaaaggtgggggtacggggggtagggtcgggggtacttaccggtccggttgggttcgttttacggaccgttacggtcgggggacgtaacgggg

SEQ ID NO: 313795 - DNA, 624 bp, Homo sapiens
  misc_feature: GZ8MTXP02JMMXM.39.71.G05.1.454.CMB.2.raw
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaggtgtccagtgtgaggtgcagctgttggagtcgtgggggaggcttggtacaggccggggggtccctggagactctcctgtgcagcctctggattcaccttcagcagctatgccatgacctgggtccgcaggctccgagggaagggctggagtgggtctcgtctattaggtggaagtggtgcttataaccaactacgcacgcctcgngagggccctnttccaccatctccagacgactatccaaagcgcactctgtactctagacaaaattcgaaacgacgcctaggacggtacgacccggaagggaacccgaccgggtaccccttaattaacgtttagttaggtacggtacggtaaaaggttggggttaggggggggacggttacggggggcccttaacggttcccgtaaggggttcggtttttacgacgttacggtcgggggacccgagggggtacccgg

SEQ ID NO: 313796 - DNA, 636 bp, Homo sapiens
  misc_feature: GZ8MTXP02H37S2.39.71.G05.1.454.CMB.2.raw
  modified_base (215)..(215): a, c, t, g, unknown or other
  misc_feature (215)..(215): n is a, c, g, or t
  modified_base (309)..(309): a, c, t, g, unknown or other
  misc_feature (309)..(309): n is a, c, g, or t
  modified_base (391)..(391): a, c, t, g, unknown or other
  misc_feature (391)..(391): n is a, c, g, or t
tcagtcgcactagtcacgaccggtgctcgatttagtgtcgtcgcaagagagagggggtcaggctggaactgaggagcagggtgggggcacttctccctctaacactctccccagcgcagcttctcttcctcctgctactctggctcccagatatcactggagaaatagtgatgacgcagtctccagccaccctctctgtgtctccaggagaaagngccaccctctcctggtacgggccagtcagagtgttagctacacttgcctggacagcagaactggccaggttcccaggctcatcatctagtggtncatccaccgagggccacgtcggcactccccgatggttcagttgggcaggtcggggtcgtgggacagtcttcactctcaaccntcagcgagtaccgtgggacgtacctaggtaaacgtttgttttacggacgttaaggttaggttaactttaacgcggtttacgaaggtaccgttaaaggttagttacggggttaaccgtccttaacccggttacccctttaccccgtaaacccggttccggggaaaccgtaaacgggggacctaaacccggtaaggttaacggaaaacgttaaacgtttaaaaaccggaaccgtttgggtaacggcc

SEQ ID NO: 313797 - DNA, 581 bp, Homo sapiens
  misc_feature: GZ8MTXP02IZQQN.39.71.G05.1.454.CMB.2.raw
  modified_base (141)..(141): a, c, t, g, unknown or other
  misc_feature (141)..(141): n is a, c, g, or t
  modified_base (297)..(297): a, c, t, g, unknown or other
  misc_feature (297)..(297): n is a, c, g, or t
  modified_base (391)..(391): a, c, t, g, unknown or other
  misc_feature (391)..(391): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtgngttttctaggtggctattttaaaaggtgtccagtgtgaggtgcagctgttggagtcgtgggggaggcttggtacaggccggggggtccctgagactctcctgtgcagcctctggattcacttcagcagctatgccatgactcggtccgccacggcncccagggagggacgtggagtgggtcgtcgtcgtattagtggtaagtggtggcttatacaaactacgcagcctccgtgaaggcggcttcaccacnctccagagactacttaccaacgagacaactaccttagtactactcgacaaatacgaacacgactagagacgacggacgacgacgaccgtactattagttacgtagtacgtaacggtagggtagggggtacggggtacggggtacgtacgtcgtcggttacggttacgtacgtacggtcgggtacggacgg

SEQ ID NO: 313798 - DNA, 546 bp, Homo sapiens
  misc_feature: GZ8MTXP02GS8WG.39.71.G05.1.454.CMB.2.raw
  modified_base (301)..(301): a, c, t, g, unknown or other
  misc_feature (301)..(301): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccacctctcctgtagggccagtcagagtgttagctaacaacttagcctggtaccagcagaaacctggccaggttcccaggctcatcatctatggtncatccaccagggccactggtactcccacgcctaccccgtttagcggctaggtgggtctggggacagacgttcactctcaccatcagcacgccctgctagtctagaaagtatttgacttagtttattactgtacaactagtacaagtgactgcctctctacgtttcgggacggtacgggaccgtaaagggtcggaagtactaacgaaaccggtaatggtacggacgtgacctacctagtcgtttcg

SEQ ID NO: 313799 - DNA, 620 bp, Homo sapiens
  misc_feature: GZ8MTXP02GUQDK.39.71.G05.1.454.CMB.2.raw
  modified_base (389)..(389): a, c, t, g, unknown or other
  misc_feature (389)..(389): n is a, c, g, or t
  modified_base (407)..(407): a, c, t, g, unknown or other
  misc_feature (407)..(407): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccgggggggtccctgagactctcctgtgcagcctctggattcaccttcagcagctatgccatcgacctgggtccgccaggcctccgaggggacggactggagtgggtctcgtctagttaggtggaagtggtagtcttaataacaaactacgcacgccctcgtgaacgggccncttccaccatctccaganactatccaagcgcactctgtactctagacaaatcgaacagcctaggacgtcgaccggaacgggaccaccgggtaccctagttaatttaagttcggtagaacggtaaaagttgggggtacggggggtaaggggtcggggggtaccttacggttcccggttaggggttcggtttttacggaccgtttacgggcggggggtacccgtaacgggggg

SEQ ID NO: 313800 - DNA, 528 bp, Homo sapiens
  misc_feature: GZ8MTXP02H69PN.39.71.G05.1.454.CMB.2.raw
  modified_base (141)..(141): a, c, t, g, unknown or other
  misc_feature (141)..(141): n is a, c, g, or t
  modified_base (166)..(166): a, c, t, g, unknown or other
  misc_feature (166)..(166): n is a, c, g, or t
  modified_base (184)..(184): a, c, t, g, unknown or other
  misc_feature (184)..(184): n is a, c, g, or t
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
  modified_base (259)..(263): a, c, t, g, unknown or other
  misc_feature (259)..(263): n is a, c, g, or t
  modified_base (265)..(266): a, c, t, g, unknown or other
  misc_feature (265)..(266): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (331)..(331): a, c, t, g, unknown or other
  misc_feature (331)..(331): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtgngtttctaggtggctattttaaaggngtcagtgtgaggtgcagntgttggagtctggggagcttggtacngccggggggtcctgagactctctgtgcagcctntggattcacttcagcnnnnncnncgcgcgcgcgngcncgaggaggngngngtggtgtgtntagtagtgagtgtgtntataccaacacncacgctcgcgcgcgtctcacactcacacactactactacacgacactactactatactactacgtaacaaatagaacgacgtacgtgacgacgacgacgacgacgtactactatagtagtacgagtaggtacggtaggggtacgggtacggtcgtacgtcgtcgttcgttacgtacgtacggtcggacggtacggcg

SEQ ID NO: 313801 - DNA, 258 bp, Homo sapiens
  misc_feature: GZ8MTXP02HCJHI.39.71.G05.1.454.CMB.2.raw
  modified_base (255)..(258): a, c, t, g, unknown or other
  misc_feature (255)..(258): n is a, c, g, or t
tcagtcgcactagtcacgaccggtgctcgatttagtgtcgtcgcaagagagagggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnn

SEQ ID NO: 313802 - DNA, 592 bp, Homo sapiens
  misc_feature: GZ8MTXP02I95HJ.39.71.G05.1.454.CMB.2.raw
  modified_base (485)..(485): a, c, t, g, unknown or other
  misc_feature (485)..(485): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccaggagaaagcgccaccctctcctgtagggccagtcagagtgttagctacaacttagcctggtaccagcaagaaacctggccaggttcccaggctcatcatctatggtgcactccaccgaggggaccacgtcggtactccccgagtccctaccgttttaggcggccgtaggtcggggtcgtaggggaacaggtacgttccaactcctaccaccatcagcacgcctgcagtctagaacgttatttgctagtttatactgttacaaactagtacaagtcgtacncgtcctactaccgtaccgtttcggggacgggtacggggtaacccgtaaaggggtacgggtaacgaacgttaaccgaaaacggtacgttacggttcgggacttaccgg

SEQ ID NO: 313803 - DNA, 532 bp, Homo sapiens
  misc_feature: GZ8MTXP02HSICE.39.71.G05.1.454.CMB.2.raw
  modified_base (252)..(252): a, c, t, g, unknown or other
  misc_feature (252)..(252): n is a, c, g, or t
  modified_base (289)..(289): a, c, t, g, unknown or other
  misc_feature (289)..(289): n is a, c, g, or t
  modified_base (334)..(334): a, c, t, g, unknown or other
  misc_feature (334)..(334): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtggtcttttcttgtggctattttaaaaggtgtccagtgtgaggtgcagctggttggagtcgtgggggaggcttggtacaggccggggggtcctgagactctcctgtgcagcctnggattcaccttcagcagctatgccatgacctggtccnccaggcctccagggaagggactggagtggtctcgtctagttaggnggaagtcggtgcttataaccaaactacgcagcctcgngagggccnctcacatcncaganactatccaaagntcaactcngtanctananaanananancngagngcgacgacgacgactatatatagtacgagagtaggtggggagggtcgggtcgtacgtcgtcgtcgttacgtacgtacgtacggacggacggacg

SEQ ID NO: 313804 - DNA, 258 bp, Homo sapiens
  misc_feature: GZ8MTXP02ILEF0.39.71.G05.1.454.CMB.2.raw
  modified_base (254)..(258): a, c, t, g, unknown or other
  misc_feature (254)..(258): n is a, c, g, or t
tcagtcgcactagtcacgaccggtgctcgatttagtgtcgtcgcaagagagagggggagtgggggctactcctggcgttttaactactgggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnnn

SEQ ID NO: 313805 - DNA, 255 bp, Homo sapiens; identical to SEQ ID NO: 313627
  misc_feature: GZ8MTXP02JNP89.39.71.G05.1.454.CMB.2.raw
  modified_base (253)..(255): a, c, t, g, unknown or other
  misc_feature (253)..(255): n is a, c, g, or t

SEQ ID NO: 313806 - DNA, 793 bp, Homo sapiens
  misc_feature: GZ8MTXP02GB6HT.39.71.G05.1.454.CMB.2.raw
  modified_base (271)..(271): a, c, t, g, unknown or other
  misc_feature (271)..(271): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtgcgtttctaggtggctattttaaaaggtgtccagtgtgaggtgcagctgttggagtctgggggagcttggtacagccggggggtccctgagactctcctgtgcagcctctggattcaccttcagcagcttancgcatcgacgtcggccgccgaggccgtaccggaaggggaacgggtacgtgggtaggtcgggtcgttcggttacttagttaggtagggtaaggttggtagtacttaacgtaacctaaacgtacgacacgtcccgttacggtacggggaaccgggcccgtaccttacccaaccctacttaccgtacccgaaagtaacgtaaacctttaacgttaacccgaaaaggaccgtacccgtacctttacgttaacgttaacgttaccgttacgtaaacgtaaaacgtaaacggtaaacgtaaccgtaccgtacggtacggtaccgggtacccgggaacgggtaacccggtaaacccggtaacccgttaacgtttaacgtttaacgtttacggttacggtaaacggtaaacgggttagggggttacggggggtacgggggtacgggggttaccggttaccggttaaccggttcgggtttaccggtttacggttaccggttaccgggtaccgggggtaccgggtaacgggg

SEQ ID NO: 313807 - DNA, 524 bp, Homo sapiens
  misc_feature: GZ8MTXP02GTZ48.39.71.G05.1.454.CMB.2.raw
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (400)..(400): a, c, t, g, unknown or other
  misc_feature (400)..(400): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggcttttctgtggctattttaaaaggtgtccagtgtgaggtgcagctgttggagtctgggggagcttggtacagccgggggggtccctgagactctcctgtgcagcctctggattcaccttcagcagctatagcatgaactgggtccgccaggctccagggaaggggctggagtggggtctcatccattagtcgtagtagtagttacatatactacgcagactngngaaggcatcacatcncaganacaacgaccaaagacncactgtatctagacaaananaacagacagagacgacgacggacgacgcgtgtagtatactgtgcgtagttagtttcggtttaggtagtgcgtactacgtacgtacgtacgggacgacggaaccg

SEQ ID NO: 313808 - DNA, 536 bp, Homo sapiens
  misc_feature: GZ8MTXP02J1FCV.39.71.G05.1.454.CMB.2.raw
  modified_base (290)..(290): a, c, t, g, unknown or other
  misc_feature (290)..(290): n is a, c, g, or t
  modified_base (376)..(376): a, c, t, g, unknown or other
  misc_feature (376)..(376): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggaggcttggtacaggccgggggggtccctgagactctcctgtgcagcctctggattcaccttcagcagctatgccatgacctgggtccnccaggctccgagggaagggactggagtgggtctcgtctatagtggaagtggtgcttataccaaactcgcagcctcgtgacgggccncttcacatctcagagactataccaagcgcactctgtatctagacaaatgaacagcctagagtgccgaggacacggccctatattatgtcgacgaaatgggtgggggagtcgggggactacgtccgtggtcgtttgacgtacgtcggggaccgaggtaccg

SEQ ID NO: 313809 - DNA, 567 bp, Homo sapiens
  misc_feature: GZ8MTXP02F2J1W.39.71.G05.1.454.CMB.2.raw
  modified_base (290)..(290): a, c, t, g, unknown or other
  misc_feature (290)..(290): n is a, c, g, or t
  modified_base (448)..(448): a, c, t, g, unknown or other
  misc_feature (448)..(448): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggcttttcttgtggctattttaaaaggtgtccagtgtgaggtgcagctgttggagtcgtgggggaggcttggtacaggccggggggtccctgagactctcctgtgcagcctctggattccaccttcagcagctatgccatgacctgggtccnccgaggctccgaggggaacggctggagtgggtctcgtctagttaggtggaagtggtgcttatacaaactacgcagccctccgtggaaacgggccgcttacaccatcctccagagacctataccaagacgcactctagtatcctgaccaaatcgaaacngcctgagtcgcgagacacggacctagtattatcgtagacgtaaagtgggttagggggaggtcgggggcctacgtccggtaggttcggtttacgacgtacggtcggggaccgtaacgggg

SEQ ID NO: 313810 - DNA, 590 bp, Homo sapiens
  misc_feature: GZ8MTXP02FHNSI.39.71.G05.1.454.CMB.2.raw
  modified_base (311)..(311): a, c, t, g, unknown or other
  misc_feature (311)..(311): n is a, c, g, or t
  modified_base (354)..(354): a, c, t, g, unknown or other
  misc_feature (354)..(354): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtttccaggagaaagagccaccctctcctgtagggccagtcagagtgttagctacaacttagcctggtaccagcagaaacctggccaggttcccaggctcatcatctatggtncatccacgaggccactgtacctcccagcctaactttagcggcnggtgggtctgggacagtagtcactctcaaccatcagcagcctcgcgagtactagtaaagtagtttagtacttaagtttaatttaacttagtactaaacgtaacgtaaacgtaaacgtagacgtacgtacctcctacctaccgtttacgggtacgggtaacgggaaccggtaaacgggtaagggtaaggtaacgtaaacgtaaaacggtaaaacgtacggtacggtacgtacgtacg

SEQ ID NO: 313811 - DNA, 567 bp, Homo sapiens
  misc_feature: GZ8MTXP02HNOST.39.71.G05.1.454.CMB.2.raw
  modified_base (388)..(388): a, c, t, g, unknown or other
  misc_feature (388)..(388): n is a, c, g, or t
  modified_base (440)..(440): a, c, t, g, unknown or other
  misc_feature (440)..(440): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggaggcttggtacaggccgggggggtccctggagactctcctgtgcagcctcgtggattcaccttcagcagctatgccatgacctgggtccgccaggcctccgaggggaacgggctggagtggggtctcgtctagttagtggaagtggtgcttaataacccaaactcgcagcctccgtgacgggccgnttccgaccatctaccgagagactataccaagacgctactctagtactcgtanacaaactgaaacagtccgtagacgtcgaccgacgacgacggaccctagtattatgtgacgaaagtggtgggggagtcgggggctacgtcgtggtcgtttacgacgtacgtcgggaccgtaggtccgg

SEQ ID NO: 313812 - DNA, 522 bp, Homo sapiens
  misc_feature: GZ8MTXP02JXFKY.39.71.G05.1.454.CMB.2.raw
  modified_base (205)..(205): a, c, t, g, unknown or other
  misc_feature (205)..(205): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
  modified_base (452)..(452): a, c, t, g, unknown or other
  misc_feature (452)..(452): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagcccaccctctctgtgtctccaggagaaagngccaccctctcctgtaggccagtcagagtgttagctacaacttagcctggtaccagcagaaacctggccaggttcccaggctcatcatctatggtgcatccaccagggccacgtggtactccccagcctaccctttagnggcaggtgggtcnggggacagtagtcactctcaccatcagcncgacctgcagtctgaagtatttgactagttttattacgtgtacaactagtacaagtgactggcctntctcgttcggacgggtaggaccgtagggtggagacgtacaaaccgtagtcgtggctacgcacacgtctcg

SEQ ID NO: 313813 - DNA, 543 bp, Homo sapiens
  misc_feature: GZ8MTXP02JZH84.39.71.G05.1.454.CMB.2.raw
  modified_base (292)..(292): a, c, t, g, unknown or other
  misc_feature (292)..(292): n is a, c, g, or t
  modified_base (351)..(351): a, c, t, g, unknown or other
  misc_feature (351)..(351): n is a, c, g, or t
  modified_base (380)..(380): a, c, t, g, unknown or other
  misc_feature (380)..(380): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggaggcttggtacaggccgggggggtccctgagactctcctgtgcagcctctggattcaccttcagcagctatgccatgaccctgggtcccnccaggctccgaggggaagggctggagtgggtctcgtctattagtggaagtggtgcttanaccaaactacgcagcctcgtgacgggccntccacatcaccagagactatccaagacgcactctgtatctgacaaatgaaacagcctgacgtgaccgaggacacggcctatattatgtgacgaagtgggtagggggagtcggggactacgtccgtggtcgtttacgacgtacggtcggggtaccgagggtccg

SEQ ID NO: 313814 - DNA, 645 bp, Homo sapiens
  misc_feature: GZ8MTXP02FN6VU.39.71.G05.1.454.CMB.2.raw
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttggtctgagctggctttttctgtggctattttaaaaggtgtccagtgtgaggtgcagctgtttgggagtcgtggggggaggcttgggtacgaggccggggggggtcccctggagactctcctgtgcagcctctggattcaccttcagcagctatgccatcgacctggggtcccgccgaggcctccgagggaagggactggagtgggtctcggtctagttagtgggaagttggngtacttatacccaaactcgcagccctcggtggacgggccncttccacctatcctaccagagtactaacttccaaagacgacactctgtactcgtagacaaagtacgaaacacggcctagacggtacgacccggaaggaaccaccggggtacccttaattaactttaagttgtaggacgtaaaaggttgggggtaggggggaggttcgggggaccgttaccgttcccgggttgggttccggtttttacggacgttaccggtcgggggacccgtaagggggtcccgg

SEQ ID NO: 313815 - DNA, 556 bp, Homo sapiens
  misc_feature: GZ8MTXP02HXXCL.39.71.G05.1.454.CMB.2.raw
  modified_base (356)..(356): a, c, t, g, unknown or other
  misc_feature (356)..(356): n is a, c, g, or t
  modified_base (388)..(388): a, c, t, g, unknown or other
  misc_feature (388)..(388): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtggcgttttctgtggctaattttaaaaggtgtccagtgtgaggtgcagctgttggagtcgtggggaggcttggtacaggccgggggggtccctgagactctcctgtgcagcctctggattcaccttcagcagctatgccatcgacctgggtccccgccaggcctccgaggggaagggctggaggtgggtctcgtctattaggtggaagtggtgcttanaccaaactacgcagcctccgtagacggggccncttcacctatcctacagacactactaccaaagngctacgtctagtnctgacaatanaanacgcctgacgcgcgacgacgaccgctactatattgtacgagaagtaggtagggggtaggtggggtcgtcgtcgtcgtcgtttacgtacgtacgtcggtcggacggacgg

SEQ ID NO: 313816 - DNA, 783 bp, Homo sapiens
  misc_feature: GZ8MTXP02JQBVF.39.71.G05.1.454.CMB.2.raw
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggaggcttggtacagggccgggggggtccctgagactctcctgtgcagcctctggattcaccttcagcagctatcgccatcgaccgtcgggtcccgccacggcctaccggaaggggaacggacgtgggaggtcggggtctcggttacgttagtttaggtagggtaaacggttggtagtactttaaacgtaaacctaaaacgttaccgacctaccgtaccccgttacccggtaggggaaacccggggtcccggtaccgtttacccgaaccctacttacccgtacccgaaacgtaacgtaaacccttaacgttacccgaaaaggaccgtaccctaaccgttccgttagttaacttaccgtacggaaactaaaacgttacgaaaccgacgtacccgttagggacggtacggacccggaacgggacccgaaccgggtaccccttaagttaagtttacgttacggttacggaaacgggtaaagggttgggggtaacggggggtacggggtcgggggtaccttaaccggttccggttacggtttccggtttacggacggtttaccgggtacgggggaccgtacgggg

SEQ ID NO: 313817 - DNA, 650 bp, Homo sapiens
  misc_feature: GZ8MTXP02JJVWN.39.71.G05.1.454.CMB.2.raw
  modified_base (291)..(291): a, c, t, g, unknown or other
  misc_feature (291)..(291): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagcgtggtcgttttcttggtggctattttaaaaggtgtccagtgtgaggtgcagctgttggagtctgggggagcttggtacaggccgggggggtccctgagactctcctgtgcagcctctggattcaccttcagcagctatgccatgacctggtccncaggctccgagggaggactggagtggtctgtctattgnggaagtggtncttacacaaactcgacagccgtcgtgaacgggccgtcttacaccatcctcccaaggtacaaacttattaccccgaaaagcgacctaaccctttcgtagtactacgtacgtaactaaataacgtaacgtacgaccgtacggtacggtacggaccggaacggaaccgaaccggtacccgttaacgttaagttaacgttacgtacggtacggtaaacggtagggggtacgggggtacggggtacggggtacggttaccggttccggtcgggttacggtttacggttacggtacggtacggggtacgggtacggg

SEQ ID NO: 313818 - DNA, 830 bp, Homo sapiens
  misc_feature: GZ8MTXP02I1UYX.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggcttttctgtggctatttaaaggtgtccagtgtgaggtgcagctgttggagtcgtgggggagcttggtacaggccggggggtccctgagactctcctgtgcagcctctggattcaccttcagcagctatgccatcgaccgtgggtcccgaccgaggcctccggaaggggaacggggtaccgtggaggtcgggtcttcgttacttagtttaggtacgggtaaaggtgggttcgactttaagtaaacccctaaaaccgttaccgacctaacggtccccttaccccggttagggaaccgggggtcccctacccgtttacccgaaaccccgttacgttacccgtaccccgaaaggtaacccggtaaacctttaaaccgtttacccgaaaacggaccggtaccctaaacctttcccgttaggttaaaccttaccgttacggaacctaaaacgttaccgaaaaccgtaacggtaccccgtttagggaacggttacccggacccgggaaacggtaccggtaaccccgggtaccccttaaagtttacgtttaacgtttagtacggtaaccggttaaaggtcgggggttaggggggtaacgggttcgggggaaccctttaccggttccggttaacggggttccggtttttacggacccggttaaccggtttcgggggacccgtaacgggggttaccccgg

SEQ ID NO: 313819 - DNA, 616 bp, Homo sapiens
  misc_feature: GZ8MTXP02IUNA6.39.71.G05.1.454.CMB.2.raw
  modified_base (521)..(521): a, c, t, g, unknown or other
  misc_feature (521)..(521): n is a, c, g, or t
  modified_base (542)..(542): a, c, t, g, unknown or other
  misc_feature (542)..(542): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggcttttcttgtggctattttaaaaggtgtccagtgtgaggtgcagctgttggagtcgtgggggaggcttggtacaggccggggggtcctgagactctcctgtgcagcctctggacttcaccttcagcagctatgccatcgaccgtcgggtccgccgaggcctccgagggggaagggcgtgggaggtgggtctcgtactccgtagttaggtggtcgccgtaggttcggtaggtaaatacgattattagtgtggtacttcggtaggaacggggtcccggttacaccgtatcctacgagaacgaacctaattcccaaaagaacctacgttctagtactctagaacctaaaagtcgaaacacgctagacggccgaccggaggaccncggtaccctagtaactttcgngtagactaaactcccgtaccgtacgtttggacgtttcgaccctaacttaccgttgaccgtcggtacgggacccg

SEQ ID NO: 313820 - DNA, 563 bp, Homo sapiens
  misc_feature: GZ8MTXP02JSO7A.39.71.G05.1.454.CMB.2.raw
  modified_base (407)..(407): a, c, t, g, unknown or other
  misc_feature (407)..(407): n is a, c, g, or t
  modified_base (433)..(433): a, c, t, g, unknown or other
  misc_feature (433)..(433): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctctgctactctggctcccagatatcactggaagaaatagtgatgacgcagtctccagccaccctctctgtgtcctccaggagaaagcgcccaccctctcctggtacgggccagtcagtagtgttagctaacaacttagcctaggtaccagcagaaacctggccacggttcccaggctcatcatctatggtgcactccaccgagggccacgtcggtactcccagccctacgtttagcgctaggtcgggtctaggggactaggagttccactcctacaccntcagcagcctgctagtctagaagttntttagcttagtttattactgtacaactagtacagtcgacgtcggtcctcgtacgtacgtttacgggacggtaacgggtaccgtaaggtggaacgtacgtaacgaaaacggtacgtcggtacggactacgg

SEQ ID NO: 313821 - DNA, 709 bp, Homo sapiens
  misc_feature: GZ8MTXP02HAFN2.39.71.G05.1.454.CMB.2.raw
  modified_base (204)..(204): a, c, t, g, unknown or other
  misc_feature (204)..(204): n is a, c, g, or t
  modified_base (342)..(342): a, c, t, g, unknown or other
  misc_feature (342)..(342): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcgagggccagtcagactatagcagcaacttagcctaggtaccagaaccaaaaccgtgaccagacctcccgaggcctcctacatgtagtggtcgccgtaccacgacgggcctacgtcggtaccncccgagccgtaggttcacggtcggacgtaggtcggggtcgtaggggactaggtacgttcacgttccaccacactacgacgccgaacggtccctacggactacgttacgtaaggttaaacgtttagtttttacgttaaactttttacgttaaacgttcgttaaccgtagttaccgttaagttaacgttacgtaaccgtttaccccggtcggttacccgttacctaaccgttttaccggttttccggggaaccccggtaacgggggtacccgtttaggggttaacgggaaacgttaaaccgttaaaccggaaaacgtaccgttggtaacggacttacggacctaaaccgttacgtttccgttacgttcc

SEQ ID NO: 313822 - DNA, 639 bp, Homo sapiens
  misc_feature: GZ8MTXP02IAOOX.39.71.G05.1.454.CMB.2.raw
  modified_base (314)..(314): a, c, t, g, unknown or other
  misc_feature (314)..(314): n is a, c, g, or t
  modified_base (363)..(363): a, c, t, g, unknown or other
  misc_feature (363)..(363): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccaggagaaagcgccacctctcctggtacggccagtcagagtgttagctaacaacttagcctggaccagacaagaacctggccacggttcccaggctcatcatctagtggtncactccaccgagggcctacgtcggtactcccgagtccctacgtttaggnggccgtagggttcgggtctaggggaacctaggtacgtttccaacgttcctaccacctactcgaacgtcacgtcctgaccgagttctaggaagtttacgttttcggactttaaggtttacttaccgttgtaaccaaacgtaacgttaaactaaagtcggtaacgtccggtacccttccgttaccgttaccgttttcgggggaacggggtaccgggtaaccgtaaggggttacggaacgtaacgtaaacgaaaacggtacgtggtacgggtactacgg

SEQ ID NO: 313823 - DNA, 692 bp, Homo sapiens
  misc_feature: GZ8MTXP02I3XYR.39.71.G05.1.454.CMB.2.raw
  modified_base (294)..(294): a, c, t, g, unknown or other
  misc_feature (294)..(294): n is a, c, g, or t
  modified_base (358)..(358): a, c, t, g, unknown or other
  misc_feature (358)..(358): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggcttttctgtggctatttaaaggtgtccagtgtgaggtgcagctgttggagtcgtgggggaggcttgggtacgagggccgggggggtccctgagactctcctgtgcagcctctggacttcaccttcagcagctatcgccatcgaccgtcggtccnccgtaggcctaccggagggagggctggagtcggtctcgtctagttagtggaagtgtgacgttanacccaaactcgactacgtcctaccggtgacggggccctcttaccgaacctcgttcctaccgagtacgaacttacttacccgaaagtacgacctacttcctagttactccgtaacgaactaaaagtacgaaaccgtacgtaccgtaggtacggtaccggaccggtacggaacccgtaccggtaccttaagttaacgtttagtacggtaacggtaacggtaaagggttcgggggtaacgggggtacgggttaccggggtaccgtttaccggttccggttaagggtttacggtttacggtaccggttacggggtacggggaccggtacgggtacccg

SEQ ID NO: 313824 - DNA, 662 bp, Homo sapiens
  misc_feature: GZ8MTXP02FUT8G.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggcttttcttgtggctattttaaaaggtgtccagtgtgaggtgcagctgttggagtcgtgggggaggcttggtacaggccgggggggtcctgagactctcctgtgcagcctctggattcaccttcagcagctatgccatgacctggtccgcaggctccgagggaggactggagtggtctcgtctatagtggaagtggtgctataccaaactcgcagcctccgtagacgggccgctcacccatctaccagacgtactacttacccaaagtacgcactctagtaactctagactaaaagtcgaaactacggacctagacggttacggacccggaagggaacctaccggggtaccccttaagttaacgttttaaaacgtttcggtagggtaccggtaaaaaggttcgggggtacggggggggtaaagggttcggggggaccgttaacccggttccggtaacggggtttcggttttacgggtaaaccgttaccgggttcgggggacccggtaagggggtaaccccggg

SEQ ID NO: 313825 - DNA, 745 bp, Homo sapiens
  misc_feature: GZ8MTXP02I92HX.39.71.G05.1.454.CMB.2.raw
  modified_base (296)..(296): a, c, t, g, unknown or other
  misc_feature (296)..(296): n is a, c, g, or t
  modified_base (402)..(402): a, c, t, g, unknown or other
  misc_feature (402)..(402): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggaggcttggtacgaggccggggggtcctgagactctcctgtgcagcctcgtggattcaccttcagcagctatgccatcgaccgtcgggtcccnccgacggcctccgaagggggaacgggtacgtgggaggtgggtctcggtactagttaggtggtaaggtggtgtacttaataacaaactcgacacgtcccgttccggnggaaaccgggcccgtccgttacaacccgtactccctaccaacgactaaccttacttaccccgaaaggaccgtacaccgttaccgttagttaacgtccgtacgtaaaccgtaaaacgttacggtaaaaccgcggtaccccgttaggggaaaccggttccgggaacccgggaacgggaaccccgtaacccgggtacccctttaaagtttaaactttagttacgggttacgaaaccgggttaaaacgggtgggggtacgggggggtagtacggggggtccttaaccggtcggttcgggtttaccggttttacgacggttaccgggtcgggggtaccgtaacggggg

SEQ ID NO: 313826 - DNA, 259 bp, Homo sapiens; identical to SEQ ID NO: 313652
  misc_feature: GZ8MTXP02GWFET.39.71.G05.1.454.CMB.2.raw
  modified_base (256)..(259): a, c, t, g, unknown or other
  misc_feature (256)..(259): n is a, c, g, or t

SEQ ID NO: 313827 - DNA, 562 bp, Homo sapiens
  misc_feature: GZ8MTXP02JY2K1.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggagcttggtacaggccgggggggtccctgagactctcctgtgcagcctctggattcaccttcagcagctatcgccatcgaccctggggtcccgccaggcctccgaggggaagggctggagtgggtctcgtctagttagtggaagtggtgcttataccaaactcgcagtcctccgtgacgggccgcttccaccatctaccagagactattccaaagtacgcactctagtactctgacaaatgaaacacgcctgacgtgccgaggaccacggtccctaattattagtgtagacgtaaagtgggtagggggaggtcgggggactacgtccgtggtcgtttagcgtacggcgggacgagggtccg

SEQ ID NO: 313828 - DNA, 258 bp, Homo sapiens
  misc_feature: GZ8MTXP02F63TU.39.71.G05.1.454.CMB.2.raw
  modified_base (254)..(258): a, c, t, g, unknown or other
  misc_feature (254)..(258): n is a, c, g, or t
tcagtcgcactagtcacgaccggtgctcgatttagtgtcgtcgcaagagagagggggagtggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnnn

SEQ ID NO: 313829 - DNA, 765 bp, Homo sapiens
  misc_feature: GZ8MTXP02HB4OD.39.71.G05.1.454.CMB.2.raw
  modified_base (300)..(300): a, c, t, g, unknown or other
  misc_feature (300)..(300): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagacgcccaccctctcctgtagggccagtcagagtgttagctacacttagcctggtaccagcagaaactggccaggtcccagctcatcatctatggtcncactcccaccgacgggccctacgtggtactccccgagtcctaccccgtttagcggtacgtagggttggggtccgttaggggacctaggtacggtttaccaccgttcctacccaaacccgtacttaccgacgggtacccaaccgtcccccgttggaaccctacggttacccgtaagggttaaaacgggtttcttttttacgggaaccttttaaagggttttttaaacctttaaccggttacggtttaaacccaaaaccgtttaacggtaaaccttaaaacgttcggtaaccgtttcgggtaaccctttccgttaccgtttacccgggtttacccgggggaacgggtaaaccgggggtaaacccgtaaagggggttaccgggaaagggttaacctaaaccggaaaaccggttaacgtcggtacggggtacccttacgggaccctaaacccgttcgtttacgttcccg

SEQ ID NO: 313830 - DNA, 545 bp, Homo sapiens
  misc_feature: GZ8MTXP02J2CCP.39.71.G05.1.454.CMB.2.raw
  modified_base (288)..(288): a, c, t, g, unknown or other
  misc_feature (288)..(288): n is a, c, g, or t
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtggcttttctgtggctattttaaaggtgtccagtgtgaggtgcagctgttggagtcgtgggggagcttggtacaggccggggggtcctgagactctcctgtgcagcctctggattcaccttcagcagctatgccatcgacctgggtcccncagtctccgagggaaggactggagtgggtctcgtctattagtggagtgtgcttanaccaaactcgcacgctccgngacgggccncttcaccntctaccagacgactacttccaagagccactctagtatctagacctaaagtcgaaacaggcctagacgtcgaccgagtacgaccgcctatattagngtcgagtaagnggggtagggggagtcgggggctacgccgtggtcgtttgacgtcgtcggggacgaggccg

SEQ ID NO: 313831 - DNA, 720 bp, Homo sapiens
  misc_feature: GZ8MTXP02IGIHI.39.71.G05.1.454.CMB.2.raw
  modified_base (277)..(277): a, c, t, g, unknown or other
  misc_feature (277)..(277): n is a, c, g, or t
  modified_base (375)..(375): a, c, t, g, unknown or other
  misc_feature (375)..(375): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggcttttcttgtggctattttaaaaggtgtccagtgtgaggtgcagctgttggagtcgtggggggaggcttgggtacaggccgggggggtccctggagactctcctgtgcagcctctggattcaccttcagcagctaancgcatcgaccgtcggtccgccgaggtccaccggaaggggaagggcgtggaggtcggtctcgtacttagttaggtaggtaaggttggtagtactttaanaacccctaaaacgtacgacacgtccgtaccggtaggaccggggtcctacttaccaccctacttacctaccgaagacgtaacttactaccgaacgtacacctacttcgtagtactctacgtaactaaagtacgaaaccgacgtaccgtaggtacggtacggacccggaacggaaccgacccgggtaccttaagttaacgtttagttacggttacggaaggtaaagggttcgggggtaggggggtaacgggttacgggggtaccgtttaaccgttccggttaacggggtttaccggttttacggtaaccggttacggggtacgggggaccgggtacgggggtaccgg

SEQ ID NO: 313832 - DNA, 539 bp, Homo sapiens
  misc_feature: GZ8MTXP02JMDYP.39.71.G05.1.454.CMB.2.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (416)..(416): a, c, t, g, unknown or other
  misc_feature (416)..(416): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctctctgtgtctccagganaaagngccacctctcctgtaggccagtcagagtgttagctacaacttagctggtaccagcagaaacctgccaggtccaggctcatcatctatggtncatccacgacgggccacgtggtactcccgagccctaccccgttttagcggctagggttcgggtcgttggggacctagtagttcacctctacacctatccagcagcctgcagtctagaactntttgcttagtttattactgtacaatagtaacaattgactggcctctctacgttcggacgggtaggaccgagggtgaacgacgtacgaaaacgacgtgtaggactacggactacacgtcttacg

SEQ ID NO: 313833 - DNA, 538 bp, Homo sapiens
  misc_feature: GZ8MTXP02FSZVX.39.71.G05.1.454.CMB.2.raw
  modified_base (244)..(244): a, c, t, g, unknown or other
  misc_feature (244)..(244): n is a, c, g, or t
  modified_base (358)..(358): a, c, t, g, unknown or other
  misc_feature (358)..(358): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccaggagaaagagcccaccctctcctgtacgggccagtcagngtgtagctacaacttagcctggtaccagcaagaaacctggaccaggttccccaggctcatcatctatggtgcatcccaccgagggcctacgtggtactcccagccctacttagngcagtggggtctggggacagagttcactctcacatcagacacgctgacgtagtctagtaagtatttgacttagtttacttagtctacaactagtaacagtacgtactcggtcctctctacgtttcggacggacggtacgaagggtggaagtactaacgaaacgtactaggtcggactacg

SEQ ID NO: 313834 - DNA, 567 bp, Homo sapiens
  misc_feature: GZ8MTXP02JZMGB.39.71.G05.1.454.CMB.2.raw
  modified_base (362)..(362): a, c, t, g, unknown or other
  misc_feature (362)..(362): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtggggggaggcttgggtacagggcccggggggggtccctggagactctcctgtgcagcctctggattcaccttcagcagctatgccatgaccgtgggtcccgccaggcctccgaggggagggactgggagtggggtctcgtctaagttggtggagtggtgcttanaaccaaactgcagcctcgtgacggggccnctcacatctcagngactatccaagancactcngtatctagacaaatgaaacagcctgacggtgaccgaacggaccaccgggaccctaagtacttagttgtcgacgaaagtggggtagggggaggtcgggggactacgtcgtggtacgtttcgacgttcgtcgggccgagggtaccg

SEQ ID NO: 313835 - DNA, 566 bp, Homo sapiens
  misc_feature: GZ8MTXP02GEA6H.39.71.G05.1.454.CMB.2.raw
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctctctgtgtctccaggagaaagcgccaccctctcctgtagggccagtcagagtgtagctacattagcctggtaccagcaagaaacctggaccaggttccaggctcatcatctatggtncatcccacgaggccacgtggtactcccagccctactttagnggcaggtcgggtctgggacagtcgttcactctcacatcagcacgcctgcagtctagtaacgtattttgacttagttttacttacgtacgttacaaacgtacgtaacaagtacgacttcggtacccttcgtacgtaccggtttcgggaccgggtacggaaaccgtaggggttacgaacgtaacgtaaccgaaaacgtacgttaggtacggactacgg

SEQ ID NO: 313836 - DNA, 717 bp, Homo sapiens
  misc_feature: GZ8MTXP02HAWKZ.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctggttggagtcgtgggggaggcgttgggtacgagggcccgggggggtccctggagactcctccgtggtgcagcctcgtggtattcaccttcagcagctatcgccatcgacctgggtccccgcgtaggcctccggaggggaacgggacgtgggaggtgggtctcggtactagtttaggtggaaggttggtacgtacgtttaataacccgtaaaaccgtccgacaccgtcccgtacggtaggaccggggtcccgtcttaccgaacctacttccgaccgagggtaaactaccttaaacgttaccccgaaaaggacgtaccctaaccttccgtagttaactcctagaactaaaatacgaaacgcgtaccgtagacgggtacgacccggaacggaccgaccggtaccttaagtacgtttagttcgtacggtaaagtaagtcgggggtagggggtacggtacgggggtccttacggttcggtcggggtttacgttacggaacgttcccgggtaggggtacccgtaaggggtccccgg

SEQ ID NO: 313837 - DNA, 726 bp, Homo sapiens
  misc_feature: GZ8MTXP02I9X5V.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggcttttcttgtggctattttaaaaggtgtccagtgtgaggtgcagctgttggagtcgtggggggaggcttggtacaggcccgggggggtcctgagactctcctgtgcagcctctggattcaccttcagcagctatcgccatcgaccgtggggtccccgccgacggcctaccggaaggggaaggggacgtgggaggtcgggtctcgtacttagttaggtaggtaaggtggtgtactttaataacccaaaaccgtcgcgaacgtcccgtaccggtaggaccggggtcccgtccgtttaccaccctacttcccgtacccaaggtaacgtaaccttaacgttaacccgaaaggacgtaccctaactcccttagttaactcgtacgactaaaacgtacgaaacacgtacctaggacggtaccggaccggacggacccgaccgggtacccttaattaagttagtttacggtaacgtacgggtaaaaggttcgggggtaacgggggggtacgggttcgggggtaccttaaccggtccggttgggttcggttttacgaccgttacggggttcgggggaccggaacggggtcccgg

SEQ ID NO: 313838 - DNA, 619 bp, Homo sapiens
  misc_feature: GZ8MTXP02JGHP0.39.71.G05.1.454.CMB.2.raw
  modified_base (352)..(352): a, c, t, g, unknown or other
  misc_feature (352)..(352): n is a, c, g, or t
  modified_base (452)..(452): a, c, t, g, unknown or other
  misc_feature (452)..(452): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaggtgtccagtgtgaggtgcagctgttggagtctgggggaggcttggtacaggccggggggtccctgagactctcctgtgcagcctcgtggattccaccttcagcagctatcgccatcgaccgtggtccgccaggcctccgagggacggactggagtggtctcgtcgtattaggtggaagtggtgcttanaacccaaagtacgcacgcctcgtagacggggccgcttccgaccactcgtaccagaacgacttaacgtaccaaaggacactaactcttacgtatccgtaanaactaaagtacgaacacgtcgtagacgacgaccgaacggaccgtaccgtacttaattattagtacggtacggtaacgtaagggtacgggggtagggggtacggtcggggtacctacggtcggtggttacggttacgacggtacgggtacggggaccggtacggaccg

SEQ ID NO: 313839 - DNA, 557 bp, Homo sapiens
  misc_feature: GZ8MTXP02GPLV7.39.71.G05.1.454.CMB.2.raw
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
  modified_base (421)..(421): a, c, t, g, unknown or other
  misc_feature (421)..(421): n is a, c, g, or t
  modified_base (449)..(449): a, c, t, g, unknown or other
  misc_feature (449)..(449): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggcttttctgtggctattttaaaaggtgtccagtgtgaggtgcagctgttggagtcgtgggggaggcttggtacgaggccgggggggtccctggagactctcctgtgcagcctctggattcaccttcagcagctatgccatcgacctggtccgccaggctccgaggggacgggtctggagtggtctcgtctagttaggtaggaagtggtgtcttataccaaactcgacacgccctcggtgacggggccncgttcaaccgtntctaccagatactatccaaganctactctgatccagacaaagtcgaaacncgcgtgagtcgacgagacacgtacctatatattgacagaaagtggggtgggggacgtcggggtactcgtccgtggtcgtttagacgttacggcgggccgtagggcccg

SEQ ID NO: 313840 - DNA, 597 bp, Homo sapiens
  misc_feature: GZ8MTXP02H1PDV.39.71.G05.1.454.CMB.2.raw
  modified_base (153)..(153): a, c, t, g, unknown or other
  misc_feature (153)..(153): n is a, c, g, or t
  modified_base (303)..(303): a, c, t, g, unknown or other
  misc_feature (303)..(303): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactgggaanaaatagtgatgacgcagtctccagcccaccctctctgtgtcctccaggagaaagcgccacctctcctgtagggccagtcagagtgttagctacaacttcgcctggtaccagcagaaacctggccaggtcccaggctcatcatctatggtncatcccaccgagggccactggtactacccgagtccctaccccgtttagcggcgagggttgggtcgtaggggactaggtagttccacttcctcaacctactcgagcacggtccctgcctagttctaggtaaagttattttcgacttagtttttactacgttgtaaccaatagtaactaatcggtaacttcggcctttctaccgtacgtttcggggacggaacggggtacctaaaggggtcgtaacgactaccggaaaacgtaccgtggtacgcgtacgacctactactcggttcg

SEQ ID NO: 313841 - DNA, 262 bp, Homo sapiens
  misc_feature: GZ8MTXP02J0EQB.39.71.G05.1.454.CMB.2.raw
  modified_base (257)..(262): a, c, t, g, unknown or other
  misc_feature (257)..(262): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagccggccctgggctgcctggtcaaggactacttccactagtgcgactgagcgggctggcaaggcgcatagnnnnnn

SEQ ID NO: 313842 - DNA, 634 bp, Homo sapiens
  misc_feature: GZ8MTXP02IRO1M.39.71.G05.1.454.CMB.2.raw
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggcttaattttaaaggtgtccagtgtgaggtgcagctgttggagtcgtgggggagcttggtacagggccggggggtcctgagactctcctgtgcagcctctggattcaccttnagcagctancgccatcgaccgtgggtccccgcaggcctccgagggaagggactggagtggtctcgtctattggnggagtggtncttataccaactcgcagcctcgngacggggcctcttccacctactctccgagacgtactacttaccaagacgacacgttcctagttactactacgactaaacttacgaaacacgtaccctggacgtacgaccggaggaccgaccggtacccgttaattacgtttacgttgtacggtacgtaaaaggttgggggtaggggggtaggtcgggggtaccgttaaccgttccggttcggttcggttttacggtacgtacggtttacggggcccggtaggggtaccccggg

SEQ ID NO: 313843 - DNA, 600 bp, Homo sapiens
  misc_feature: GZ8MTXP02JJIUQ.39.71.G05.1.454.CMB.2.raw
  modified_base (291)..(291): a, c, t, g, unknown or other
  misc_feature (291)..(291): n is a, c, g, or t
  modified_base (339)..(339): a, c, t, g, unknown or other
  misc_feature (339)..(339): n is a, c, g, or t
  modified_base (370)..(370): a, c, t, g, unknown or other
  misc_feature (370)..(370): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttctgtggctattttaaaggtgtccagtgtgaggtgcagctgttggagtcgtgggggaggcttggtacgaggcccgggggggtccctgagactctcctgtgcagcctctggattcaccttcagcagctatgccatgacctgggcccnccaggctcgaggagggctggagtggtctcgtctagttgtggagtggtncttataccaactgcagcctcgtgacgggccncttcacctatctccagacgactacttaccaagtacgactactactgttactcgtcgaacaaaagtcgaaacacgtaccgtagaggtacgccgaacggaccgaccggacccttaagttactttagttaggtacgacggtaaagtgggggtaggggggtaggttcgggggtacctacgtccggtgggttcggttttacggaccgtacggtcggggccggtaacggggtccgg

SEQ ID NO: 313844 - DNA, 259 bp, Homo sapiens; identical to SEQ ID NO: 313652
  misc_feature: GZ8MTXP02GF546.39.71.G05.1.454.CMB.2.raw
  modified_base (256)..(259): a, c, t, g, unknown or other
  misc_feature (256)..(259): n is a, c, g, or t

SEQ ID NO: 313845 - DNA, 652 bp, Homo sapiens
  misc_feature: GZ8MTXP02J0S9L.39.71.G05.1.454.CMB.2.raw
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggctaattttaaaaggtgtccagtgtgaggtgcagctgttggagtcgtgggggaggcttggtacgaggccgggggggtccctggagactctcctgtgcagcctctggattcaccttcagcagctatcgccatcgaccgtcgggtcccgccgaggcctccggaggggaagggacgtggagtggtctcggtctagttaggnggaagtggtgacttanaaccaaactcgcacgtcctccgtggacgggccgtcttccacctactctaccagacgtactactaccgaagacgctactctgtactctagaacctaaagtacgaaacacgtcctaggacgtcgaccgacggaaccgaccggtacctaagtttacttaagttcggtacggaacggaaagggtcgggggtagggggggtaaggttcgggggtaccttaccggttccggttaacggttcggttttacggacgtttaccgggtacgggggtacccggaggggtaccccgg

SEQ ID NO: 313846 - DNA, 647 bp, Homo sapiens
  misc_feature: GZ8MTXP02GIX8I.39.71.G05.1.454.CMB.2.raw
  modified_base (297)..(297): a, c, t, g, unknown or other
  misc_feature (297)..(297): n is a, c, g, or t
  modified_base (556)..(556): a, c, t, g, unknown or other
  misc_feature (556)..(556): n is a, c, g, or t
  modified_base (608)..(608): a, c, t, g, unknown or other
  misc_feature (608)..(608): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtagcttaattttaaaaggtgtccagtgtgaggtgcagctggttggagtcgtggggggagcgttggtacagggccgggggggtccctggacgactctcctgtgcagcctctggattcaccttcagcagctatgccatgacctggtccnccaggctccgagggaagggctggagtcgggtctcggtactagttaggtagggtaaagttgggtgacgtttaataacccgtaaaaaccttccgacaaacggtccccttacccgggtaggaaccgggggtcccctaccgtttccaaacccgtacttccgtacccgaagaacgtaccttaactttacccgaaaagacgtccaaactcctagtatcctagacaaaatcgaaacagcctgacgcgaccgagacaccggccctanacttattgacgacgtaaagtcgggtaggggggatcgggggactacgtccggnggttccgtttagacgtacggtgggacccgaggtacccgg

SEQ ID NO: 313847 - DNA, 813 bp, Homo sapiens
  misc_feature: GZ8MTXP02JCSGD.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaggtgtccagtgtgaggtgcagctgttggagtcgtgggggaggcttggtacgaggccgggggggtcctggagactctcctgtgcagcctctggattcaccttcagcagctatgccatgacctggtccgccaggcctccgagggaagggctggagtggtctcgtctagttaggtggaagtggtgacttataccaaactacgcacgtccctacggtgacgggggccctactttccgaaccctaatcccgtacccaaagggtacgaaccttaactttacccaaacgtacggacctaaccttacccgttagttacttaccgaggtaactaaaaacttacggaaaacctaacggtacccccgttaagggaagggtttacccggaccccggggtaaaacggggtaacccccggaaccccgggggtaacccccttaaggtttaaagtttaaaacccgtttcggggtaacggtaacccggggtaaaaaacggtttcggggggttaaacggggggggggttaaaaggggtttcgggggggggtaaccctttaaacccgggtttccccggttaagggggttcccgggttttttttaacgggaaaacccggtttcccggggttaccggggggttaacccggacgggggttaaacccccgggg

SEQ ID NO: 313848 - DNA, 616 bp, Homo sapiens
  misc_feature: GZ8MTXP02JPPOP.39.71.G05.1.454.CMB.2.raw
  modified_base (296)..(296): a, c, t, g, unknown or other
  misc_feature (296)..(296): n is a, c, g, or t
  modified_base (356)..(356): a, c, t, g, unknown or other
  misc_feature (356)..(356): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtggtcttttctgtggctaattttaaaggtgtccagtgtgaggtgcagctggttggagtcgtgggggaggcttggtacgaggcccggggggtcctggagactctcctgtgcagcctctggattcaccttcagcagctatgccatcgaccgtgggccccncgaggcctaccggaaggggaacgggactggggaggtcggtcctcggtcttaagtttaggngggaaagttggtgtacttagtaaccctaaactcgcaacgtcccgtacggttaggacggggccctacttccacctagtcctaccaggacgactacttaccaaggacaccatctagtactcganacaanagaacacgtcgacgacgacgacgacgacgacgtacgtatatagtagtacgtacgtaggtagggtagggggtacgggtcgggtacgtacgtcggtcggtcggttacgtacggtacggtcggtacggacggtcgg

SEQ ID NO: 313849 - DNA, 610 bp, Homo sapiens
  misc_feature: GZ8MTXP02J3OBG.39.71.G05.1.454.CMB.2.raw
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
  modified_base (471)..(471): a, c, t, g, unknown or other
  misc_feature (471)..(471): n is a, c, g, or t
tcagtcgcactagtcacgaccggtgctcgatttagtgtcgtcgcaagagagagggggtcaggctggaactgaggagcaggtgggggcacttctccctctaacactctcccagcgcagcttctcttcctcctgctactctggctcccagatatcactggaagaaatagtgatgacgcagtctccacgccacctctctgtcgtctccaggagaaagcgcccacccttctcctggtacggccagtcagtgtgtagctaacacttgcctggaaccngacaacgaaccgtgggcctacggtcccaggtcctnatcattcgattcggcnctactcccgacgaacgggcctaacgttcggtacctcccgacgtccttacgtttaggcggccgtagggttcgggtccgtaggggaactaggtacttccaaccttccacacctacacagccacgcctagacctagttctaggtaaacttntttaggactttaagtttactttacagtaactaacgtacgtaactagtacgaccgtcgtcctacgtaccgtacggttcgggacggtaaccggacgtaaggtacggaactaacgtacgaaaaccggtgtcggtaccacgtc

SEQ ID NO: 313850 - DNA, 767 bp, Homo sapiens
  misc_feature: GZ8MTXP02INC78.39.71.G05.1.454.CMB.2.raw
tcagtcgcactagtcacgaccggtgctcgatttagtgtcgtcgcaagagagaggagcccagccctgggatttttcaggtgttttcatttggtgatcaggactgaacagagagaactcaccatggagtttgggctgagctggtctttttcttgtggcttattttaaaaggtgtccagtgtgaggtgcagctgttggagtcgtgggggaggtcgttgggtacagggccggggggtccctggacgacctctccgtgtcgcgacgtccctccggtatttccaccttcgagcagtctagtcgcctatcgaccgtcgggtccccgccgaggtccgtaccggaaggggaacgggtacctggggaggttcggggtccttacgtaccgtttaaggttaggttagggaagttgggttacgtacctttaagtaacccctaaaaccgtccgacgtacgtaccccgttacccggaggtaccgggggcccttaccttacccgaaccctaacgttcccgtaaaccaggaaccgttaactaaaccgtttaccgaaaacggcgtaacccgtaaaccgttcgttaacgttaaacttccgttacgaaaccctaaaaggtaccaaacgacgtacccgtagggacgtaccggaccgaacggaaccgtaccgtaaccttaagttaactagtttcggtagaacggttaaagtggggtacgggggacggttcggggtaacttcgtacggttggtacgtttacgacggttacggtcggacggtagggtaccg

SEQ ID NO: 313851 - DNA, 615 bp, Homo sapiens
  misc_feature: GZ8MTXP02HAXW6.39.71.G05.1.454.CMB.2.raw
  modified_base (299)..(299): a, c, t, g, unknown or other
  misc_feature (299)..(299): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagcgccaccctctcctggtacgggccagtcagagtgttagctacacttgctggtacagcagaaacctggccaggtcccaggctcatcatctagtggtncactccaccgacgggccacgtcggtactcccacgtcctaacccgtttaggcggacagggttcgggtacgtggggacaggtacgttccactcctacacctatacgagcacgcctgcagttactaggtaacgttatttggacttaagtttacttactacggttacaaacgttacgttaaacaagttcgaaccgttcggtcccttacgttaccgtaacggtttccggggaacgggtaaacgggtaccgaaggggttacggaacgtaacgtaaaccgaaaacgtaacgtggtacgtactacgacctactatccgtttacg

SEQ ID NO: 313852 - DNA, 260 bp, Homo sapiens
  misc_feature: GZ8MTXP02GLPH2.39.71.G05.1.454.CMB.2.raw
  modified_base (256)..(260): a, c, t, g, unknown or other
  misc_feature (256)..(260): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnnn

SEQ ID NO: 313853 - DNA, 762 bp, Homo sapiens
  misc_feature: GZ8MTXP02GE5F2.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtgggggaggcgttggtacgagggccggggggtccctgagactctcctgtgcagcctctggacttcaccttcagcagctatcgccatcggaccgttcgggtcccgccgacggcctacccggaagggggaaacggggtaccgtaggggaggttcggggtccttcggttacttaagtttaagggtaggggtaaaggttggtagtactttaagtaaaccccgtaaaaccgtaccggacgtaacggtcccccgtttaccgggtagggaaccgggggtccctacctttacccgaacccgtacttcccgtacccaaaggtacgtaacccttaacttacccgaaaggacgtacctaacgttccttaggtacttacgtacgaactaaaagtcgaaaccgacgtcccgtaagggacggtcgacccggaaggacctacccggtaaccttaagttacgtttagttagtacgaaacggttaaaggtgggggtagggggtagggtacgggggtaccttaccgttccggtggggtttctttacggaccggtttacggcggggtaccgacgggtacccg

SEQ ID NO: 313854 - DNA, 562 bp, Homo sapiens
  misc_feature: GZ8MTXP02FS194.39.71.G05.1.454.CMB.2.raw
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttggtacaggccgggggggtcctgagactctcctgtgcagcctctggattcaccttcagcagctatgccatcgacctgggtccgccaggctccgagggaaggactggagtgggtctcgtctattaggtggaagtggtgtcttatacaaactacgcacgccctcgtggaacgggccgcttaccgaccatctcccagagactattaccaaagagacactctgtactctgacaaatgaaacagctgagtcgcgaggacacggcctaacgtattacttgtagacgaaagtggggtagggggagtcgggggcttaacgtccgtggtcgtttacgacgttacggtcggggcgtaacggggg

SEQ ID NO: 313855 - DNA, 706 bp, Homo sapiens
  misc_feature: GZ8MTXP02JFE8Y.39.71.G05.1.454.CMB.2.raw
  modified_base (313)..(313): a, c, t, g, unknown or other
  misc_feature (313)..(313): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttctgtggcttaattttaaaaggtgtccagtgtgaggtgcagctggttggagtcgtgggggagcttggtacgagggcccggggggtccctgacgtactctccgtgtgcagcctctggtacttccaccttcagcagctaactcgacctagtcgtacccgtcgggtcccnccgaggccctacggaagggacggacgtgggagtcggtctcgtacgtagttaggtaggtagtggtgtacttaataaccctaacgtcgacacgtcctacggacgacgggcctctaccaccagtcctacgagtactacttactacgaaagcgtcctattccgtatacttaccgagtaactaaatcgaaacgtacgcgtagtacggacggaccgaacggacccgtacggtaccttaagtttacgttagttacggtacggtaaaacggttaaggggtcggggggttagggggtaaccggggttcggggttaaccctttcggttcccggggtttaaggttccgggtttaaacgtaccgggtacgggtccgggggtaacccgggtagggttaacccccgg

SEQ ID NO: 313856 - DNA, 259 bp, Homo sapiens
  misc_feature: GZ8MTXP02ITZ4S.39.71.G05.1.454.CMB.2.raw
  modified_base (255)..(259): a, c, t, g, unknown or other
  misc_feature (255)..(259): n is a, c, g, or t
tcagtcgcactagtcacgaccggtgctcgatttagtgtcgtcgcaagagagagggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnnn

SEQ ID NO: 313857 - DNA, 530 bp, Homo sapiens
  misc_feature: GZ8MTXP02F68E7.39.71.G05.1.454.CMB.2.raw
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (310)..(310): a, c, t, g, unknown or other
  misc_feature (310)..(310): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagcccaccctctctgtgtctccaggagaaagngcccacctctcctgtagggccagtcagngtgttagctacaacttgcctggtaccagcaagaacctggccaggtcccaggctcatcatctatggtncatcccacgaggcctacgtcggtactcccagccctacgtttagcggctaggtgggtctggggacaggtacgttcactctaccactactcagcagcctgctagtctagtaagtattttgattagtttattactgtactaactagtaacatgacgtcgacctctactacgttcggacggtacggaccaggtgaagtactacgaaacgtactggtacgctacg

SEQ ID NO: 313858 - DNA, 258 bp, Homo sapiens
  misc_feature: GZ8MTXP02FJUYB.39.71.G05.1.454.CMB.2.raw
  modified_base (256)..(258): a, c, t, g, unknown or other
  misc_feature (256)..(258): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnn

SEQ ID NO: 313859 - DNA, 261 bp, Homo sapiens
  misc_feature: GZ8MTXP02IKWBK.39.71.G05.1.454.CMB.2.raw
  modified_base (258)..(261): a, c, t, g, unknown or other
  misc_feature (258)..(261): n is a, c, g, or t
tcagtcgcactagtcacgaccggtgctcgatttagtgtcgtcgcaagagagaggggggagtgggggctactcctggcgttttaactactgggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcagtagnnnn

SEQ ID NO: 313860 - DNA, 521 bp, Homo sapiens
  misc_feature: GZ8MTXP02HTMAM.39.71.G05.1.454.CMB.2.raw
  modified_base (193)..(193): a, c, t, g, unknown or other
  misc_feature (193)..(193): n is a, c, g, or t
  modified_base (214)..(214): a, c, t, g, unknown or other
  misc_feature (214)..(214): n is a, c, g, or t
  modified_base (350)..(350): a, c, t, g, unknown or other
  misc_feature (350)..(350): n is a, c, g, or t
  modified_base (445)..(445): a, c, t, g, unknown or other
  misc_feature (445)..(445): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctntctgtgtctccaggagaaagngccaccctctcctgtaggccagtcagagtgttagctacaacttagcctggtaccagcagaaacctggccaggttccccaggctcatcatctatgtgcatccacagggccacgtcggtactcccagcctactttagnggcaggtggtctggggacaggtagttcactctacacatcagcacgcctgctgcctagaacgatcgctgactaacttattactgtaacaaaagttntagacgtgtcgtcgtggtacgtccggaccgacggacgtaaggtagaaacgtacgaaacgtacgtggtcgactcgac

SEQ ID NO: 313861 - DNA, 855 bp, Homo sapiens
  misc_feature: GZ8MTXP02JM6AU.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttctgtgtctattttaaaggtgtccagtgtgaggtgcagctgttggagtcgtgggggaggcttggtacgaggccggggggtccctgagactctcctgtgcagcctctggattccaccttcagcagctatcgccatcgacctgggtcccgccgaggcctccgagggaagggacgtggaggttcgggtctcgtcttaagttaggtagggtaagttggtagtacctttaataaccgtaaaccgttacgcgaacgtcccgttaccggtagggaccgggggtcccgtacctttaccgaacccctacgttcccgttaacccgaacgggtaaaccggtaaaccctttaacgtttaacccccggaaaaggtaaccggtacccgttaaaccctttacccgttagggtttaaaccttcccgtttaacggaaacccgttaaaaaactttcgggaaaacccgtaaacgggtacccccgtttaaagggtaacccgggttaccgggaaccccggggtaaaacggggaacccccggtaaacccggggtacccccttaaaagtttaaccgtttaacgtttaggtacgggtaaccggtaaaagggttcgggggtacgggggggtaagggttccggggggtaaacctttccgggttaccggttcggggttccggtttttacggaccggtttaccgggtccgggggttacccggacggggttaccccggg

SEQ ID NO: 313862 - DNA, 543 bp, Homo sapiens
  misc_feature: GZ8MTXP02H77YH.39.71.G05.1.454.CMB.2.raw
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (265)..(265): a, c, t, g, unknown or other
  misc_feature (265)..(265): n is a, c, g, or t
  modified_base (303)..(303): a, c, t, g, unknown or other
  misc_feature (303)..(303): n is a, c, g, or t
  modified_base (413)..(413): a, c, t, g, unknown or other
  misc_feature (413)..(413): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctccagatatcactggagaaatagtgatgacgcagtctccagccaccctntctgtgtctcagganaaagcgccacctntcctggtacggccagtcagagtgtagctacacttagctggtaccngcagaacctggccaggtccaggctcatcatctatggtncactcccacgacggccacgtcggtactcccacgtcctaacgtttggcgcgtaggtcgggtctgggacagtacgttcactctcacctatcgagcacgctgcagtctagatntttcgattagtttatactcgtacaacgtacgtaacattacgacttcggtcctctacgtaccggtttcgggacgggtacgggaactacgggtaggaacgtacgtaacgaaacggtacgtggtacgcgtacg

SEQ ID NO: 313863 - DNA, 683 bp, Homo sapiens
  misc_feature: GZ8MTXP02GFBFO.39.71.G05.1.454.CMB.2.raw
  modified_base (201)..(201): a, c, t, g, unknown or other
  misc_feature (201)..(201): n is a, c, g, or t
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
tcagtcgcactagtcacgaccggtgctcgatttagtgtcgtcgcaagagagaggggcccagccctgggattttcaggtgtccagtgtgaggtgcagctgttggagtctgggggaggcttggtacaggccgggggggtccctgagactctcctgtgcagcctctggattcaccttcagcagctatgccatgacctgggtccnccgaggctccgaggggaaggactggagtggtctcgtctattagnggaagtggtgcttanacaaactcgcagcctcgtggacggccnctcacatcncaganactatccaagncactctgtactctagacaaatgaaccagcctagacgtcggaccgaggccgaccggaccttaagtattacgttggtacggaacggtaaagtgggggtacggggggaggtcggggggaccttacgttcggtagggttcggttttacgaccgttacgggtcgggggaccgagggggtacggccccgttcgggtcctacccgggttcctacccgtcgtaaccgccccgttacccgaaccggaaaccggggtcccctaaccggttccgggtttcccccgttcccccggttacggggccccgtaccccgtcgtccccgtaccggtacgggaaccgtcccgtaacccgtaccgggacgaaccgcccgaacggcccggg

SEQ ID NO: 313864 - DNA, 778 bp, Homo sapiens
  misc_feature: GZ8MTXP02GTXG5.39.71.G05.1.454.CMB.2.raw
  modified_base (277)..(277): a, c, t, g, unknown or other
  misc_feature (277)..(277): n is a, c, g, or t
  modified_base (297)..(297): a, c, t, g, unknown or other
  misc_feature (297)..(297): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtcttttcttgtggcttattttaaaaggtgtccagtgtgaggtgcagctgttggagtcgtgggggaggcttggtacgacggccgggggggtcctgagactctccgtgtgcagcctctggattcaccttcagcagctancgccatcgacctgggtcccncgaggcctacggaaggggaacggcgtgggaggtcgggtctcgtcttaggttaggtggtaagtggtacgtattaacgtaaaccgtaaactacgacgaccgtcccgttcggtacgggaacgggccctccgttaccaccctatccaccgaagactaacctacgttaccgaaaggtacaccttaccgtcgttactaacttccgttaacgaaaacctaaattaacgggaaaccctaacgcccgttagggtacgaccgggacccgggtaaacggaacccggaaaccccggttacccgtttaagtttaaaactttcgggttttaaggaaccggttaaaacgggttaaaacgtttacgggggtttcgggggtaaggggggtaacgggggtttccgggggtaaccttttaacccggttaccggtttcgggggtttttacggtttaccgggtaaccggtttaaccgggggttccggggggtaaccccgggg

SEQ ID NO: 313865 - DNA, 718 bp, Homo sapiens
  misc_feature: GZ8MTXP02JLA58.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaggtgtccagtgtgaggtgcagctgttggagtcgtgggggaggcttggtacgaggccggggggtcctgagactctcctgtgcagcctctggattcaccttcagcagctatcgccatcgaccgtgggtcccgccgaggcctccggaggggaacggggactgggaggtgggtctcgtacttagttaggtgggaagtgggtgacgttaataaccccaaacgtacgcaacgcccgtaccggtaggacggggccctcttaccgaccctatcctaccaaaggaacgaccttaacgttacccaaaggacgtacctaacttcctagttaactcgtacgaactaaaacgtacgaaacgacgtaccgtaggtaacggtcggaaccggaacggaacccgaaccggtacccttaagttaacgtttacgttaggtacggtaaaccggtaaaagggttcgggggtaagggggggttaacgggtcggggggtaccttaaccggttcccggttggggttaccgttttacggtaacgttaccggggtcgggggtacccggaaggggtccccgg

SEQ ID NO: 313866 - DNA, 562 bp, Homo sapiens
  misc_feature: GZ8MTXP02H0L6D.39.71.G05.1.454.CMB.2.raw
  modified_base (290)..(290): a, c, t, g, unknown or other
  misc_feature (290)..(290): n is a, c, g, or t
  modified_base (399)..(399): a, c, t, g, unknown or other
  misc_feature (399)..(399): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaaggtgtccagtgtgaggtgcagctgttggagtccgggggagcttggacaggccggggggtccctgagactctcctgtgcagcctctggattccaccttcagcagctatgccatgaccctgggtcccncgaggctccgagggaaggctggagtggtctcgtctagtagtggaagtggtgtcttaatacaaactcgactagcctcgtgaacgggccgtacttcaccctatcctccganacgtactacttaccaaagacgacaactctagtactactagacaaatacgaacagcctgagtcgacgagacgacgacctattatatagtgacgtaaagtgggtagggggagtcgggggactcgtacgtggtcgtttgacgtacggtcggccgacgggcgtccgg

SEQ ID NO: 313867 - DNA, 260 bp, Homo sapiens
  misc_feature: GZ8MTXP02J1Z4D.39.71.G05.1.454.CMB.2.raw
  modified_base (255)..(260): a, c, t, g, unknown or other
  misc_feature (255)..(260): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggctacttccactagtgcgactgagcgggctggcaaggcgcatagnnnnnn

SEQ ID NO: 313868 - DNA, 260 bp, Homo sapiens
  misc_feature: GZ8MTXP02JGYTL.39.71.G05.1.454.CMB.2.raw
  modified_base (257)..(260): a, c, t, g, unknown or other
  misc_feature (257)..(260): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttccccctggcgccctgctccaggagcacctccgagagcacagcggccctgggctgcctggtcaaggactacttccactagtgcgactgagcgggctggcaaggcgcatagnnnn

SEQ ID NO: 313869 - DNA, 781 bp, Homo sapiens
  misc_feature: GZ8MTXP02JF7MR.39.71.G05.1.454.CMB.2.raw
tcagtcgcactagtcacgaccggtgctcgatttagtgtcgtcgcaagagagaggagcccagccctgggattttcaggtgttttcatttggtgatcaggaccgaacagagagaactcaccatggagtttgggctgagctggcttttctgtggctattttaaaggtgtccagtgtgaggtgcagctggttggagtcgtgggggagcttggtacgaggccggggggtcctgagactctcctgtgcagcctctggattcaccttcagcagctatgccatcgaccgtgggtaccccgccgaggcctaccggaaggggaaacggggtacgtggggacggttcggggtccttcggttacttaagtttaggtagggtaaaggtgggttgtacgtttaataaacccgaaaaccgttacgacctaacggtccccgttaccgggtaggaccgggggtccctaccgtttaccgaaccctaacgttccctacccgaaagtaaccgtaaaccttacgttaacccgaaacgtacggtaccctaaacttcccgtagttaactaccgtagaaacctaaaagttacggaaaacacgacccgttaggaacggtacggacccggaacggaacccgaaccggtacccttaaagttactttagttggtacggtaacggtaaaaggtgggggtaacggggggtaagggtcgggggtaccttaaccggttccggttaacgggttacggtttttaccggaaaccggttacgggttaccgggggaccggttaacgggggtaccccgg

SEQ ID NO: 313870 - DNA, 786 bp, Homo sapiens
  misc_feature: GZ8MTXP02GFCA3.39.71.G05.1.454.CMB.2.raw
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgttggagtcgtgggggaggtcgttgggtacgacgggcccggggggggttccctggacgtaccttcctccgtgtgccacgccctcgtggtattccacttcagcagctatcgccatcgaccgtgggtccccgccgaggcctaccggaaggggaacggacgtgggacgtgggtctcgttactagttaggtggtaaagtggtagtacttaactaactaaacctacgcacggcccttacggtggaaccgggcccgtcttaccgacctacttccaccaagtacgtaaccttaacgttacccgaaaggacgacctaacttccgttagttaacttaccgtagtaaaccaaaagttacggaaaccacggtacccgttagggaaccggttaccggaccccgggaaacggaaccccgtaaacccggggtaacccctttaaagttttaaactttaggtttacggttaggaaaccgggttaaaaagggtcggggggttaaacgggggggtacgggtttaacggggggtccctttaaccgggttcccggttaggggtttaccggtttttacggaaaccggttcgggtacgggggacccgtaaaccggggg

SEQ ID NO: 313871 - DNA, 885 bp, Homo sapiens
  misc_feature: GZ8MTXP02IPJR9.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagatagaactcaccatggagtttgggctgagctggctttttcttgtggctattttaaaggtgtccagtgtgaggtgcagctggttggagtcgtgggggaggcgttggtacgaggccgggggggtccctggagactctcctgtgcagcctctggacttcaccttcagcagctatcgccagtcgacccgtcgggtcccgccgacggcctaccggaaggggaaacggggtacgtggggacgggttcgggtccgttcgtacgtttagtttaggtagggtaaaggttgggtacgtactttaacgtaaaccctaaaaccgttaccggacctaccggtccccgttacccgggtaacgggtaaccgggggtcccccggtaccctttcccgaaacccccgttaaccttccccgttaaccccgtaaacggtaaaccgttaaacccttaaaacccgtttaacccgaaaaacgggaccggtaccccttaaccgttaccgttaaacgggtttaaactcccgtttaacggaaaccgtaaaaacgtttaaccgggaaaaccgtaccggtacccgttaaggtaacgggttaccgggacccgggtaaaccgggaacccgtaaccccgggtaaccctttaaagttaacgtttaagtttaccggtagggtaaacggttaaaaggggtcgggggttaagggggggtacgggttcgggggtacccgttaccggtccggtttaagggttccgttttacgggtaaccgtacgggtcgggggtacccggtaacggggtccccgg

SEQ ID NO: 313872 - DNA, 584 bp, Homo sapiens
  misc_feature: GZ8MTXP02I11WY.39.71.G05.1.454.CMB.2.raw
  modified_base (288)..(288): a, c, t, g, unknown or other
  misc_feature (288)..(288): n is a, c, g, or t
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
tcagtcgcactagtcacgaccggtgctcgatttagtgtcgtcgcaagagagaggggcccagccctgggattttcaggtgttttcatttggtgatcaggactgaacagatagaactcaccatggagtttgggctgagctggctttttcttgtggcttattttaaaaggtgtccagtgtgaggtgcagctgttggagtctgggggaggcttggtacaggccggggggtcctgagactctcctgtgcagcctctggattcaccttcagcagctatgccatgacctggtccnccaggcctccgagggaggctggagtggtctcgtctattagtggaagtggtgcttanaccaaactcgcagcctccgtgacggggccncttcaccntctaccagacgactacttaccaaagacgcactcctagtacttctagacaaaattacgaaacacgccctaggacgtacgacccggaggaccaccgggaccctaagttattattggtagacgtaaaagtcggggtagggggtaggtcgggggtactaccgtcgtggtcgttttacgacgtacggttcggggcgaacgggtccgg

SEQ ID NO: 313873 - DNA, 735 bp, Homo sapiens
  misc_feature: GZ8MTXP02HH8DZ.39.71.G05.1.454.CMB.2.raw
  modified_base (178)..(178): a, c, t, g, unknown or other
  misc_feature (178)..(178): n is a, c, g, or t
tcagtcgcactagtcacgaccggtgctcgatttagtgtcgtcgcaagagagagggggtcaggctggaactgaggagcagggtgggggcacttctccctctaacactctccccagcgcagcttctcttcctcctgctactctggctcccagatatcactggaagaaatagtgatgacgnagtctccagccaccctctctgtcgtctcgaaggaagaaagcgccctaccctctccgtggtacggcctagtcgagtagtgttacgctaacaacgttcgcctaggtaccagacctaaacgtaaacccgtcgggtaccgtaacgggtttccccagggtacctccgtaagttccgaattccgttaagtggggttaccgacctaccttaccccgaaaccggtcggggtacccctaaggttccccgtaaccgtacccccgaacgttaccccttaacggttttacgcggtaccggtaaggggttcgggtacgtacggggatagggtacttacccactaccgtacctaaacccgtacgtaccgtagaccgtaccgtaccgtacgacgtagtacgttaagtacgtttagttacggttatttacgtttaacgttacgtacgtaactaagtaagtaactagtaccgtcgttacggtaccttacgtacggttaccggtacgggaacgggtaacggtaacgtagggtacgtaacgtaacgtaacgtaacgtacgtcggtacggtacgacg

SEQ ID NO: 313874 - DNA, 643 bp, Homo sapiens
  misc_feature: GZ8MTXP02F6GUL.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttctgtggctattttaaaaggtgtccagtgtgaggtgcagctgttggagtcgtgggggagcttggtacgaggccggggggtccctgagactctcctgtgcagcctctggattcaccttcagcagctatcgccatcgacccgtcgggtcccgccaggcctccggaaggggaagggcgtgggaggtgggtctcgttactaagttggtagggagttggtcgtactttaacaaccaaactacgcacggtccctaccgtagggaccggggcctcttaccgacctatcctaccgagacgactactaccaagacgacactctagtactctagacaaaagtcgaaacacgacctaggaggtccgaccggacggacaccggtacctatacgtttagtggtacgacggaaagttggggtagggggtacggggttacgggggaccttaccgttccggttgggttccgtttacggacggttacgggtacgggggaccgacggggtacccgg

SEQ ID NO: 313875 - DNA, 626 bp, Homo sapiens
  misc_feature: GZ8MTXP02IB0UV.39.71.G05.1.454.CMB.2.raw
  modified_base (304)..(304): a, c, t, g, unknown or other
  misc_feature (304)..(304): n is a, c, g, or t
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
  modified_base (452)..(452): a, c, t, g, unknown or other
  misc_feature (452)..(452): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggctattttaaaaggtgtccagtgtgaggtgcagctggttggagtcgtggggggaggcttgggtacgagggcccggggggggtccctggacgactctctgtgcagcctctggattcaccttcagctacgctatcgccatcgaccgtgggccnccaggcctccgaggggaaagggctggacgtgggtctcgtntagttagtggaagtggtgcttaaanaaccaaacgtcgacacgtccgtccggtaggaccggcctactaccacctactccacagactactactacaagacactactcgtntatactacgtacaaatacgaacacgtacgtagtacggtacgacgacgaccgaccgtaccgttatatagttagtacggtacgtaaggtagggtagggggtacggggtacggggtacggtacgttcggttcggttcggtttacggtacggtacggtacgggtaccggacggtacgg

SEQ ID NO: 313876 - DNA, 256 bp, Homo sapiens
  misc_feature: GZ8MTXP02FXFIC.39.71.G05.1.454.CMB.2.raw
  modified_base (256)..(256): a, c, t, g, unknown or other
  misc_feature (256)..(256): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagn

SEQ ID NO: 313877 - DNA, 760 bp, Homo sapiens
  misc_feature: GZ8MTXP02IOBWS.39.71.G05.1.454.CMB.2.raw
tcagtcgcactagtcacgaccggtgctcgatttagtgtcgtcgcaagagagaggggcccagcccctgggattttcaggtgttttcatttggtgatcaggactgaacagagagaactcaccatggagtttgggctgagctggtctttttcttgtggcttattttaaaaggtgtccagtgtgaggtgcagctggttggagtcgtgggggaggcgttggtacgagggcccggggggtcctgagactctccgtgtgcagcctcgtggtattccaccttcagcagtctagtcgcctagtcgtacccgtcgggtccccgccgaggtccccgtaccggaaggggaaacgggtccgtaggggtacggttggggttccttacgttcgtttaaagtttagggtaggtaaaggtttggtacgtactttaactaaacccgtaaaaccgtccgacgacgtcccgttacccggtaggacggggtccctcttaccaccctctccacgagacgtactacttaccgaaagcgtacctacttccgttagtactacgtacgaactaaaattacgaaacgtcgtacgtagggtacgtaccggacccggaacggaacccgtaccggtaccttaagtttaacgttagttcgggtaacggtaacggttaaagggtcgggggttacggggggacggtttaccgggggtacccttccggttaccggttcgggttcggttttacggtaccggtacggttccgggggaaccgtaggggtacccccgg

SEQ ID NO: 313878 - DNA, 563 bp, Homo sapiens
  misc_feature: GZ8MTXP02GM1OE.39.71.G05.1.454.CMB.2.raw
  modified_base (193)..(193): a, c, t, g, unknown or other
  misc_feature (193)..(193): n is a, c, g, or t
  modified_base (339)..(339): a, c, t, g, unknown or other
  misc_feature (339)..(339): n is a, c, g, or t
  modified_base (411)..(411): a, c, t, g, unknown or other
  misc_feature (411)..(411): n is a, c, g, or t
  modified_base (435)..(435): a, c, t, g, unknown or other
  misc_feature (435)..(435): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagccaccctntctgtgtcctccaggagaaagcgccaccctctccgtggtacgggccagtcagagtgtagctacatagctgtaccagcagaacctggccaggtccagctcatcatctagtggtcacatcccgacgacggggccctagtcgggtaccnccccgagtacccttaccgttttaggcggtccgtaggtcggggtccgtaggggactagtacttcactctcacntcagcacgctgacgagcagaacgngtggtgacttaggtttatacgtgtactaactattattaactaatctaccgtatacgttacgtttacggacgaacggggtaccaggtaccgtaagggaactactaaacgtaaacgtacgtggtacgtcg

SEQ ID NO: 313879 - DNA, 747 bp, Homo sapiens
  misc_feature: GZ8MTXP02GL8A3.39.71.G05.1.454.CMB.2.raw
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggaggtcgttgggtacgacgggcccggggggggtccctggacgactcctccgtgtgcacgcctcgtggtacttccaccttcagcagctatcgcctagtcgaccgtcgggtcccgccgacggcctaccggaagggggaacgggacgtggggacggtcggggtctcggttacttagttaggtagggtaaggttgggtcgtactttaactaaaccaaacgtacgactacggccccgttacgggtcgggaaaccgggtcccgtacgttaccaaccctactacccgtacccgaaagtacgttaaaccttaaccgttaaccgaaaacggtacgtaccctaccttctaacggttaacctccgtaagaaacctaaaagtacgaaaccgacgtcccgtaggtacggtaccggaaccggacgtaaccgacccggtaccttaagttaacgttagtttaggcgtaaaggtaaaggttgggggagggggtacggtacggggtcttaccggttcgttggttacggttttcgaacgttacgggtcgggaccgtaacgggg

SEQ ID NO: 313880 - DNA, 607 bp, Homo sapiens
  misc_feature: GZ8MTXP02IZ3PN.39.71.G05.1.454.CMB.2.raw
  modified_base (433)..(433): a, c, t, g, unknown or other
  misc_feature (433)..(433): n is a, c, g, or t
  modified_base (463)..(463): a, c, t, g, unknown or other
  misc_feature (463)..(463): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccacgccaccctctctgtgtctccaggagaaagcgccacctctcctggtaggccagtcagagtgtagctacaacttagcctggaccagcaacgaaacctggcctacggttccccaggcctcatcatcgtagtggtcgctactccccgaaccgacggggcctacgttcggtactccccgagtaccccttacgtttaggcgggcgtagggttcggggtcgacggggacaggtacgttccaacgtcctcaacccngtacagcacgctgctagtctagtaagtttntttcggatttacgtttatacgtactacaagtacgtaactaagtcgtagccgtccttcgttaccgttacgtttacggggaccgggtaaggtaacccggtaaggtcggaaagacgttaacgaaaacggtcgttggtacgcggtaac

SEQ ID NO: 313881 - DNA, 688 bp, Homo sapiens
  misc_feature: GZ8MTXP02F5I0F.39.71.G05.1.454.CMB.2.raw
  modified_base (382)..(382): a, c, t, g, unknown or other
  misc_feature (382)..(382): n is a, c, g, or t
  modified_base (494)..(494): a, c, t, g, unknown or other
  misc_feature (494)..(494): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttctgtggctattttaaaaggtgtccagtgtgaggtgcagctggttggagtcgtgggggaggcgttggtacgagggccggggggtccctggacgtactctccgtgtgcagcctctggacttccaccttcagcagctatcgcctagtcgaccgtcgggtcccgcgacggccgtccggaagggaacggggtactgggtaggtcgggtctcgtacgttagttaggtagggtaaggtggtntacgttaacgtaacctaaacgtaccgtacgacgtccgtaccggtagggaccggggtccctacttaccgacctacgtacctaccgagtaccgtaacttacgtaccgaaagtcncctactcgttagtactcgtagaactaaagtacgaactaacgtcgtagtacggtacgacccgggtaagaccgtacccgaccttagtacttagtcggtagtacggtaaggtcggggtacgggggtaggtaccggggtactcggtcccgtggtttacgttacgacggttcggtacgggggtaccgacgggtacccgg

SEQ ID NO: 313882 - DNA, 683 bp, Homo sapiens
  misc_feature: GZ8MTXP02GHD8N.39.71.G05.1.454.CMB.2.raw
  modified_base (254)..(254): a, c, t, g, unknown or other
  misc_feature (254)..(254): n is a, c, g, or t
  modified_base (300)..(300): a, c, t, g, unknown or other
  misc_feature (300)..(300): n is a, c, g, or t
  modified_base (380)..(380): a, c, t, g, unknown or other
  misc_feature (380)..(380): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtggtcttttctgtggctatttaaaggtgtccagtgtgaggtgcagctggttggagtcgtgggggaggcgttggtacgagggccgggggggtcctggagactctcctgtgcagcctntggacttcaccttcagcagctatgaccagtcgacctcggggtcccnccaggcctaccggaaggggaacgggactggggagtcgggtacttcggtctagttaggtgggtaagttggtgtacgttaanaaccctaaacgtcgcacggtccctacggtagaccggggtcctcttaccgacctgtacctaccgaagtaacgaccttaacttaccgaaacgagtacctaacgtccttacgtatccgtaacaactaaagtacgaacgtacgtcgtaggtacggacgacccggaacggtacccgtaaccgtaccttaagttacgttacgttacggtacggtaacggtaagggtcgggggtagggggtacggtcgggtacgttacggtcggttcggttacggtttacgacggttacgggtcgggacggtacggtccg

SEQ ID NO: 313883 - DNA, 265 bp, Homo sapiens
  misc_feature: GZ8MTXP02I2QRY.39.71.G05.1.454.CMB.2.raw
  modified_base (172)..(172): a, c, t, g, unknown or other
  misc_feature (172)..(172): n is a, c, g, or t
  modified_base (259)..(265): a, c, t, g, unknown or other
  misc_feature (259)..(265): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttccccctggccgccctgctccaggancacctccgagagcacagcggccctgggctgcctggtcaaggctacttccatagtgcgactggagcgggctgggacaaggcgcagtgnnnnnnn

SEQ ID NO: 313884 - DNA, 639 bp, Homo sapiens
  misc_feature: GZ8MTXP02JIMX7.39.71.G05.1.454.CMB.2.raw
  modified_base (308)..(308): a, c, t, g, unknown or other
  misc_feature (308)..(308): n is a, c, g, or t
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtcttttcttgtggctattttaaaaggtgtccagtgtgaggtgcagctggttggaggtcgtgggggaggcttgggtacagggcccggggggggtccctggacggacctctccgtgtgcacgcctctggattcaccttcagcagctatgccatcgaccgtcggggtcccnccgacggcctccgaagggggtaaacggcgttgggaggttcgggtctcggtcgttagttaggtaggtaagttggtacgtactttaacaactaaaacgtacgcaacggtccctcggtagggaacggggcctcttaccacctacttccncaaagngtaaacctattaccaaagtcgactactcgtntatctanacaatacgacgtacgcgtagacgtcgacgacgacgacgactatagttagttacgtagtaggtaaggtaggggtagggggtacggggtacgggtcggtcgtcgtcggttacggttacgtacgtacggtcgggtacggtacgg

SEQ ID NO: 313885 - DNA, 612 bp, Homo sapiens
  misc_feature: GZ8MTXP02I5IEQ.39.71.G05.1.454.CMB.2.raw
  modified_base (290)..(290): a, c, t, g, unknown or other
  misc_feature (290)..(290): n is a, c, g, or t
  modified_base (335)..(335): a, c, t, g, unknown or other
  misc_feature (335)..(335): n is a, c, g, or t
  modified_base (469)..(469): a, c, t, g, unknown or other
  misc_feature (469)..(469): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggagcttggtacaggccgggggggtccctggagactctcctgtgcagcctctggattcaccttcagcagctatgccatgacctgggtccnccaggctacgaggggaggctggagtgggtctcgtactagttaggnggtaaagtgggtgctttactaacgaaacctacgacacgcctccggtgaaacggggcccgacttacacccattcctacccagtacgactacttaccgaaggacactactactgtaattcagacaaattgaaaccngacgtagacgacgacggacggacgtacggtaccttagttaacgttagttcgtacggtacggtaaaggttggggtacgggggacggtcggggtacttacggtccgttcggttacgtttacgacgtacggtacggggaccgaggg

SEQ ID NO: 313886 - DNA, 782 bp, Homo sapiens
  misc_feature: GZ8MTXP02IG11O.39.71.G05.1.454.CMB.2.raw
tcagtcgcactagtcacgaccggtgctcgatttagtgtcgtcgcaagagagaggggcccagccctgggatttttcaggtgttttcatttggtgatcaggactgaacagagagaactcaccatggagtttgggctgagctggtctttttctgtggcttattttaaaaggtgtccagtgtgaggtgcagcttggttggagtcgtggggggaggtcgtttgggtacgagggtcccggggggggtccctggacgactctccgtgtgcagcctcgtggtacttccaccttcagcagctaatcgccatcgaccgtcgggtcccgccgaggtcctaccggaaggggaacgggtctggggaggtcgggtcttcggttactagttaggtagggaagtggtagtactttaagtaaccccgaaaacgttaccgacctaacggtcccgtaccgggttgggaaccgggggtccctaccttaccaaaccctacgttcccgaccgtaacggtaacgttaaacctacgtttaaccccgaaagggtaaccgtaccctaacggtttcccttaggttaacctccgttaacgaactaaaacgttacgaaaaccctacgggtacctaggtacggtaccggaccccggaaaggtacccgacggttaacccttaagtttacgttagttcggtaagtacggttaaaagggtcgggggtaggggggtaacggtcgggggtaaccttcgtaccggttggtttacggtttacggacgttacgggtcgggggtaccgtacgggtacccgg

SEQ ID NO: 313887 - DNA, 713 bp, Homo sapiens
  misc_feature: GZ8MTXP02I9X29.39.71.G05.1.454.CMB.2.raw
  modified_base (255)..(255): a, c, t, g, unknown or other
  misc_feature (255)..(255): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtcttttcttgtggctattttaaaaggtgtccagtgtgaggtgcagctgttggagtcgtgggggaggcttggtacagggccggggggtccctgacgtactctccgtgtgcagcctntggacttcaccttcagcagctatcgctatcgaccgtcgggtcccgaccgaggcctaccggaggggaacgggacgtaggggaggttcgggttcgtcggttacgtttaggtttaacggttagggaaaggtttggggtacggtaccttttaaataaaccgtaaaaccgtacgtaccgtaaaccgttccccgttacccggtacgggggtaaaccggggtccccggtctttacccgaaccctacgttccctacccgaaagaccgtaccttaacgttaacccgaaaggtactactaaccttcgttattaactcgttagaaccaaagttacgaaacacgccgtagagtcgaccggacgacgtaccggtccctagttattcgtacgtgaacgtaaggtgggtagggggtacgtcggggtctacgtcggtgttaccggttcgtacgtacggtcgggtacgtaccggg

SEQ ID NO: 313888 - DNA, 820 bp, Homo sapiens
  misc_feature: GZ8MTXP02I4EJK.39.71.G05.1.454.CMB.2.raw
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttcttgtggcttattttaaaaggtgtccagtgtgaggtgcagctggttggagtcgtggggggaggtcgtttgggtacgacgggcccgggggggtccctggacgtacctcttccgtgtcgcacgtccctcgtggtacttccaccttcacgcagctatcgccatcgaccgtcgggtcccgccgaggctccggaaggggaacgggactgggaggttcgggtctcgttacttagttaggtagggtaagttggtgtactttaacgtaaaccgaaaacgttaccgacgtaacggtcccccgttaccgggtaggggaaaccgggggtcccccgttacctttacccgaaaccctacttaccgttacccgaaacgtaacgtaaacccttaactttaacccgaaaggtacgtaccctaaaccttcttaggttaaacgttctaacggtaaacctaaaagttacgaaaccgtacgtcccgttagggtaacggtccggaccgggaaggaaccccgtaaccggtaccctttaagttaagtttacgtttaggtacggtaaaccgggtaaagggttcgggggttaggggggacggggttaccggggggtacctttaacccggttcggttacgggtttaccggttttacggaaaccggtttacgggggtcgggggtaccccggtaacggggg

SEQ ID NO: 313889 - DNA, 260 bp, Homo sapiens
  misc_feature: GZ8MTXP02G3GXJ.39.71.G05.1.454.CMB.2.raw
  modified_base (255)..(260): a, c, t, g, unknown or other
  misc_feature (255)..(260): n is a, c, g, or t
tcagtcgcactagtcacgaccggtgctcgatttagtgtcgtcgcaagagagaggggggagtgggggctactcctggcgttttgactactggggccagggagccctggtcaccgtctcctcagcctccaccaagggcccatcggtcttcccctggcgccctgctccaggagcacctccgagagcacagcggccctgggctgcctggtcaaggctacttccactagtgcgactgagcgggctggcaaggcgcatagnnnnnn

SEQ ID NO: 313890 - DNA, 256 bp, Homo sapiens
  misc_feature: GZ8MTXP02FIOTO.39.71.G05.1.454.CMB.2.raw
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcncatagn

SEQ ID NO: 313891 - DNA, 677 bp, Homo sapiens
  misc_feature: GZ8MTXP02GNE09.39.71.G05.1.454.CMB.2.raw
  modified_base (513)..(513): a, c, t, g, unknown or other
  misc_feature (513)..(513): n is a, c, g, or t
  modified_base (616)..(616): a, c, t, g, unknown or other
  misc_feature (616)..(616): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggctttttcttgtggctaattttaaaaggtgtccagtgtgaggtgcagctgttggaggtcgtgggggaggtcgttgggtacgagggcccgggggggtccctggacgactctccgtgtgcagcctctgtacttccacttcagcagctatcgccagtcggaccgtcgggtcccgcccgaggccgtccggaaagggggaacgggcgtaggggacggttggggttcctcggttacttagtttaagggtagggtaaagttggtagtactttaactaaccaaaccgtacgccgacgtccctacgggtggaacggggtccctccttaccaacctactcctaccagacgtacttagtacaagacgcactctagtactacgtanactaaatacgaaccgactaccgtaggacgtggacccggaggaaccgtaccggtacccttaagttattagttacggtacgaggtaaaggtgggggtacgggggnggtcgggggtcctacgtcgtcgggttcgtttacggacgtacgggtcggggtaccgacgggg

SEQ ID NO: 313892 - DNA, 263 bp, Homo sapiens
  misc_feature: GZ8MTXP02JOSF1.39.71.G05.1.454.CMB.2.raw
  modified_base (172)..(172): a, c, t, g, unknown or other
  misc_feature (172)..(172): n is a, c, g, or t
  modified_base (258)..(263): a, c, t, g, unknown or other
  misc_feature (258)..(263): n is a, c, g, or t
tcagtcgcactagtcacgaccggtgctcgatttagtgtcgtcgcaagagagaggggggagtgggggctactcctggcgttttgactactggggccagggagccctggtcaccgtctcctcagcctccaccaagggcccatcggtcttccccctggccgccctgctccaggancacctccgagagcacagcggccctgggctgcctggtcaaggctacttccactagtgcgactgagcgggctggacaaggcgcatagnnnnnn

SEQ ID NO: 313893 - DNA, 902 bp, Homo sapiens
  misc_feature: GZ8MTXP02IBZMK.39.71.G05.1.454.CMB.2.raw
  modified_base (200)..(200): a, c, t, g, unknown or other
  misc_feature (200)..(200): n is a, c, g, or t
  modified_base (345)..(345): a, c, t, g, unknown or other
  misc_feature (345)..(345): n is a, c, g, or t
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagcccaccctctctgtntctccgaggagaaagcgcccaccctctccgtggtacggccagtcagagttagttacgactactaacgtcgtccgtacggtaaccagacgaacgaaaccgtcggaccgtacggttccccgaggctacatcaattctaagtcgggtncctaacgtccccaaccgtacggggacccctacggttcccggtaccctacccccgtacgtacccccgtttaacgttttaacggggtcgggtaccgggttaacgggggtttcggggggttaccggttaacgggggaaccgttaaacggggtttaccgtttacccgtaacccgttccctaaccccgtaaaccctaacgttacccgaacccgacccgtaacccggtccccgtttacggaacccgttaccggttaccggttaaaggttaaaccggttttagtttttaccgggttaccgtttttaaacggttttttaaccgttaaccgtttaaccggtaaaccgttaaaacccgttaaaggtttaaaacctaacggtttaacggtaaacccgggtttcccggttaccccttacccggtttaccggttaacccggggtttttaccccgggggaacggggtaaacccgggggttaaacccggttaaggggtaacccgggtaagtaaacccggttaaaccggttaaaacccggtacggtttacgggtaccgggtacgttaacccgg

SEQ ID NO: 313894 - DNA, 616 bp, Homo sapiens
  misc_feature: GZ8MTXP02GF0VQ.39.71.G05.1.454.CMB.2.raw
tcagtcgcactagtcacgaccggtgctcgatttagtgtcgtcgcaagagagagggggtcaggctggaactgaggagcaggtgggggcacttctccctctaacactctccccagcgcagcttctcttcctcctgctactctggctcccagatatcactggagaaatagtgatgacgcagtctccagcccaccctctctgtgtctccaggagaaagcgcccaccctctccgtgtacgggccagtcagagtgtagctacaacttagcctaggtaccagcaagaaacctggcctaggtccccaggctacatcattctagtggtcgctactcccgaaccgtacgggacctacgtcggtactccccaggcccttaaccgtttaggcggcgtagggttcggggtcgtaggggacctaggtacgttccactctaccacgactcagcagcctgctagtctagtagttacgtttgacttagtttactacgtcgtaactaactaggttaacaagttcgacgttcggtacccttcttaccggttaccggtttacggggacggtaaacggggtaaccaagggggtaccgaaagtaccgtaacgaaaacgtacgtcggacgtacgtaccg

SEQ ID NO: 313895 - DNA, 745 bp, Homo sapiens
  misc_feature: GZ8MTXP02HE0MA.39.71.G05.1.454.CMB.2.raw
  modified_base (266)..(266): a, c, t, g, unknown or other
  misc_feature (266)..(266): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggcttttctgtggctattttaaaaggtgtccagtgtgaggtgcagcgtgttggagtcgtgggggaggcttggtacagggccggggggtccctggacgactctcctgtgcagcctctggattcaccttnagcagctatcgccagtcgacctgggtccgccgacggcctaccgaaggggaaggacgtggggaggtgggtctcgttacttagttagggtaggaaggttgggtcgtacgtttaactaaccgaaaacgttccgacacgtaccccgttcgggtcgggaaacgggggtcccttaccttacccgaaaccctaactccgttacccccgaaagtacgtaaaccctttaacgttacccccgaaaaggggttacccgaaccgttaaaccttcccgtttaggttaaactccttacggaaacccttaaaagttcggaaaacacggtccccttagggaaccggacggacccgaaggggacccctaaacgggtcccttaaagttattaacgttggacggtaaccgtaaagtttgggggaacgggggtggtacgggggtaccttacggccgttaggtcgtttaggaaccgtttcggacgggggccctaaggggg

SEQ ID NO: 313896 - DNA, 766 bp, Homo sapiens
  misc_feature: GZ8MTXP02FOLL5.39.71.G05.1.454.CMB.2.raw
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggtctttttcttgtggcttattttaaaaggtgtccagtgtgaggtgcagctggttggagtcgtgggggagtcgttggtacgagggccggggggtccctgagactctcctgtgcagcctcgtggacttccaccttcagcagctatcgccatcggaccgtcgggtcccgcgacggcctccgaggggaaggcgtggagtggtctcgtacttagttaggtagggtaaagtggtagtactttaataaaccccgtaaaaccgtaccgacgtacgtccccgttacccggttagggaccgggggtccccctacctttaccgaaccccgtactttcccaccgtaaacgtaacgtaaccttaactttaacccgaaagtacgtaccctaccttacgtttagttaaaccttctacgtaaacctaaaagttaccgaaaacgtaccggtcctacgggtaacggtaccggacccggaaacgggaaccgaacccggtacccttaaatttaagttacgttacggtagtaacggtaaaggttcgggggtagggggtaacggttcgggggtaccttacggttcccggttgggtttcccggtttaggtaccggttacggttacgggggaccggtacggggtaccccgg

SEQ ID NO: 313897 - DNA, 580 bp, Homo sapiens
  misc_feature: GZ8MTXP02FJXRV.39.71.G05.1.454.CMB.2.raw
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
  modified_base (458)..(458): a, c, t, g, unknown or other
  misc_feature (458)..(458): n is a, c, g, or t
tcagtcgcactagtcacgaccggtgctcgatttagtgtcgtcgcaagagagagggggtcaggctggaactgaggagcagggtgggggcacttctccctctaacactctccccagcgcagcttctcttcctcctgctactctggctcccagatatcactggagaaatagtgatgacgcagtctccagccaccctctctgtgtctccgaggagaaagacgcccaccctctccgtgtacgggccagtcagagttgttagctacaactagcctggaccagcaagaaacctggccaggttcccagctnatcatctatggtncactccacgaggcctactcgtactcccagtcctacgttaggcggcagggtcggggtacagggggacagtacgttccacgtcctaccacctatcagcacgctgcagttcaggtaaattgttttcgattagttttactacgttntacaacgtagttaacaattggactcggtaccttcgtaccgttacggtttcggggacgggtaacggaaccgtagggggtagaacgtaacgtaaaccgaaacggtaccgtaggtcgacgtaccg

SEQ ID NO: 313898 - DNA, 603 bp, Homo sapiens
  misc_feature: GZ8MTXP02IG02B.39.71.G05.1.454.CMB.2.raw
  modified_base (264)..(264): a, c, t, g, unknown or other
  misc_feature (264)..(264): n is a, c, g, or t
  modified_base (344)..(344): a, c, t, g, unknown or other
  misc_feature (344)..(344): n is a, c, g, or t
  modified_base (372)..(372): a, c, t, g, unknown or other
  misc_feature (372)..(372): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
  modified_base (426)..(426): a, c, t, g, unknown or other
  misc_feature (426)..(426): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttcttgtggctaattttaaaaggtgtccagtgtgaggtgcagctgttggagtcgtgggggagcttggtacaggccggggggtcctgagactctctgtgcagcctctggtattcaccttnagcagctaatgccatcgaccgtggtacccgcaaggctaccgaagggaaggactagggagtggggtctacgtctaattagnggaaagtggtgacttataacaaaatcgnanccgtcgtgaagggcncttcaccatacnccagacgaactattaccaaagacanaaaccttactagtatactacgaacaaataacgaaacgtaacgacgtacgacgtacgaccggaacgaacgaacgtacctaactaattaattagtagtagaaagtagggtagggggtacgggtacgggtacgtacgtaacgtcggtacgttacgtacgtacggtacgggtacggtacgg

SEQ ID NO: 313899 - DNA, 259 bp, Homo sapiens
  misc_feature: GZ8MTXP02JD1L8.39.71.G05.1.454.CMB.2.raw
  modified_base (250)..(250): a, c, t, g, unknown or other
  misc_feature (250)..(250): n is a, c, g, or t
  modified_base (256)..(259): a, c, t, g, unknown or other
  misc_feature (256)..(259): n is a, c, g, or t
tcagtcgcactagtcacgaccggtgctcgatttagtgtcgtcgcaagagagaggggggagtgggggctactcctggcgttttaactactggggccagggagccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcncatagnnnn

SEQ ID NO: 313900 - DNA, 666 bp, Homo sapiens
  misc_feature: GZ8MTXP02I2JKJ.39.71.G05.1.454.CMB.2.raw
  modified_base (410)..(410): a, c, t, g, unknown or other
  misc_feature (410)..(410): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagctggctttttcttgtggctattttaaaggtgtccagtgtgaggtgcagctgttggagtcgtgggggagcttggtacaggccggggggtcctgagactctcctgtgcagcctctggattcaccttcagcaggctatgccatcgacctggggtcccgccaggcctccgagggaacgggactgggagtgggtctcgtctagttgtggagtgtgcgttatacccaaactacgcacgtcctccggtagacggggccctacttacccgacctacgttccnccaagaacgtactaacttcccaaaggacactactcctagtaattccgtagactaaaacgtacgaaaccaacgtacccgttggaacggtcggacccggaacggaacccgaccgggtacccgttaattacgtttaacgttaggtaccgtacggtaaaaggtcggggtaggggggaaggtttcgggggacgttaaccgttccggtcgggttcggtttacggtaccgttacgggacgggggtaccgaagggggtccccgg

SEQ ID NO: 313901 - DNA, 693 bp, Homo sapiens
  misc_feature: GZ8MTXP02FGRVE.39.71.G05.1.454.CMB.2.raw
  modified_base (319)..(319): a, c, t, g, unknown or other
  misc_feature (319)..(319): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtcttttcttgtggcttattttaaaaggtgtccagtgtgaggtgcagctgttggagtcgtgggggagcttggtacagggcccggggggtccctggacgactctccgtgtgcagcctctggtattccaccttcagcagctatgccatgaccgtggtcccgcaggcctccgaggggaggacnggagtggtctcgtctagtaggtaggaagtggtgtacttaataccaaactacgctacgcccgtccggttcggaacggggcccgtcttacccaacctacgttcctaccgaagactaaccttacttacccgaaagacgtaccaacctttcgtacgttataccttaggaaacctaaaactggaaaacccgtcgtaccgtagggacgtaccggaaccggaacggtaacccgtaccgtaacctttaagtttaacgtttaggttacggtaacggaaggttaaagggtgggggtacgggggtacgggttcggggtaccttaccggttcggttacgggtttacggtttacgaccggttacggggtaccggggacggtaacggg

SEQ ID NO: 313902 - DNA, 675 bp, Homo sapiens
  misc_feature: GZ8MTXP02FLFID.39.71.G05.1.454.CMB.2.raw
  modified_base (184)..(184): a, c, t, g, unknown or other
  misc_feature (184)..(184): n is a, c, g, or t
tcagtcgcactagtcacgaccggtgctcgatttagtgtcgtcgcaagagagaggggggaggaactgctcagttaggacccagacggaaccatggaagccccagcgcagcttctcttcctcctgcctactctggctcccagatatcactggagaaatagtgatgacgcagtctccagccaccctntctgtgtcctccaggagaaagacgccaccctctcctggtacggccagtcagagtgttagctacaattagcctggtaccagcagaactggccaggttcccaggctcatcatctatggtcgcaatccacgacggccagtcgtactccacgcctaccccgttgtcgctagtgggtctaggggcagtacgtctactcgtacaactacgtacacggtccaacggccttacgccctaaagtcgttaggtaaaagtttcgtttttaggtaccctttaaacgggttttatttaaccggtactttaaacccgtaaaacggttactttaaaaccggaaatttacggaaacccgttaccgggtaccccttcgacccgtttaaacccgggtttcgggaaccgggggtttaaacgggaccgttaaaaggggcggtaaacggtaacctaaaacggaacgtaaacgtgggtacgtacctacgtacccgaacgtacttccgtttacg

SEQ ID NO: 313903 - DNA, 720 bp, Homo sapiens
  misc_feature: GZ8MTXP02IGY7Z.39.71.G05.1.454.CMB.2.raw
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtggcttttctgtggctattttaaaggtgtcagtgtgaggtgcagctgtggagtctgggggaggcttgggtacaggccgggggggtccctggagactctcctgtgcagcctcgtggattcaccgttcagcagctangccatcgactgggtccccncgagcacggagggacggngtggagtcggtctcgtatagtaggtaggagtgtntacttaanaacccgtaaacgtcgcacgtcccgtaccggaggaccgggtcctacttaccacctactcctacgaacgtacgtactactaccgaagtacgacctacgttactacgtaacttaccgtagtaactaaacgtaaacgtaaaccgtaacgtaccgtacggtacggtaccggaccggaacggaaccggtaaccggtaacccgttaacgtttaacgtttaacgttaacggttaacggtaacggtaaacgggttacgggggttacggggggtaacgggggtacgggggttaccggttaccggttaccggttaacgggtttacggtttacggttaccggttaaccgggtaccggggtaccgggtaaccgggtaccgg

SEQ ID NO: 313904 - DNA, 676 bp, Homo sapiens
  misc_feature: GZ8MTXP02FMN69.39.71.G05.1.454.CMB.2.raw
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
  modified_base (409)..(409): a, c, t, g, unknown or other
  misc_feature (409)..(409): n is a, c, g, or t
tcagtcgcactagtcacgaccggtgctcgatttagtgtcgtcgcaagagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggagcttggtacaggccggggggtccctggagactctcctgtgcagcctntggattcaccttcagcagctatgccatcgacctgggtcccnccaggctaccgaggggaaggactggagtggtctgtctagttaggtggaagtggtgtacttactaacaaactacgctagccccgtcggtggaacgggcccgtacttacccaaccgtnttaccctaccgaacgacgtaccttaacttacccgaaagacgacaaccttcgtacgtaactcttacgaacctaaagtacgaaacgacgtacccgttagggacgtacgaccggaacggaacccgtaccgggtaccccttaattaagtttacgttacggtaggacggtaaaagtcgggggtaggggggtacgggttacggggggaccttaccggtccgttcgggttacggtttacggtacgttaccgggtcggggacccggtaacggggg

SEQ ID NO: 313905 - DNA, 680 bp, Homo sapiens
  misc_feature: GZ8MTXP02GRC86.39.71.G05.1.454.CMB.2.raw
tcagtcgcactagtcacgaccggtgctcgatttagtgtcgtcgcaagagagaggggcccagcccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggagcttggtacaggccggggggtccctggagactcctcctgtgcagcctcgtggtattcaccttcagcagtctatgccatcgaccgtgggtcccgcgacggcctacggaggggtaagggactggaggtcggtctcgtacgttagttaggtgggtaagtggtgtacttaatacccaaaacgtcacgacgtcccgtaccggttagacgggggtaccctccgttaccaccgacttaccgtccgaagaacgtacctacttaccgaaagtacgccactccgtatactcgtacaacaaagttacgaaacgcgaccgttaggaacggtcgaccggaacggaccgacccgtaacccgttataacgtttagttacggtacgtaacggtaaagttgggggtacgggggtaggtacgggggtacttaaccggtcgtcggtttacgtttacggtacttaaccggggtcggtaccggtagggtccccgg

SEQ ID NO: 313906 - DNA, 577 bp, Homo sapiens
  misc_feature: GZ8MTXP02FNLF8.39.71.G05.1.454.CMB.2.raw
  modified_base (196)..(196): a, c, t, g, unknown or other
  misc_feature (196)..(196): n is a, c, g, or t
  modified_base (217)..(217): a, c, t, g, unknown or other
  misc_feature (217)..(217): n is a, c, g, or t
  modified_base (361)..(361): a, c, t, g, unknown or other
  misc_feature (361)..(361): n is a, c, g, or t
  modified_base (434)..(434): a, c, t, g, unknown or other
  misc_feature (434)..(434): n is a, c, g, or t
tcagtcgcactagtcacgaccggtgctcgatttagtgtcgtcgcaagagagaggggggtcaggctggaactgaggagcaggtggggggcacttctcccctctaacactctccccagcgcagcttctcttcctcctgctactctggctcccagatatcactggagaaatagtgatgacgcagtctccagccaccctntctgtgtctccaggagaaagngccaccctctcctgtagggccagtcagagtgttagctacaactagcctggtaccagcagaaacctggccaggttcccaggctcatcatctatggtgcactccaccagggccctagtcggttactccccagccctacctttaggngggctaggtggggtctagggacaggagttcactcctccaccatcagcacgcctagcaagtctaggaaacgttnttttacgctagtttttagttactcgtaccaaacacgttacaatacgactacgggtccttccgtcctacgtttcgggacgggtacgggaaccgtaaggtacgggaagtaactaacgaaaacggtaactacggtacggactacgg

SEQ ID NO: 313907 - DNA, 586 bp, Homo sapiens
  misc_feature: GZ8MTXP02I0JP1.39.71.G05.1.454.CMB.2.raw
  modified_base (141)..(141): a, c, t, g, unknown or other
  misc_feature (141)..(141): n is a, c, g, or t
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
  modified_base (265)..(266): a, c, t, g, unknown or other
  misc_feature (265)..(266): n is a, c, g, or t
  modified_base (268)..(269): a, c, t, g, unknown or other
  misc_feature (268)..(269): n is a, c, g, or t
  modified_base (299)..(299): a, c, t, g, unknown or other
  misc_feature (299)..(299): n is a, c, g, or t
  modified_base (440)..(440): a, c, t, g, unknown or other
  misc_feature (440)..(440): n is a, c, g, or t
tcagtcgcactagtcacgaccggtgctcgatttagtgtcgtcgcaagagagaggggcccagccctgggattttcaggtgttttcatttggtgatcaggactgaacagagagaactcaccatggagtttgggctgagcgtgngtttctaggtggctatttaaaggtgtcagtgtgaggtgcagctgttggagtntggggagnttggtacngccggggggtcctggngactctcctgtgcagcctntggatcaccttcagcagtntnncnncgcgtcggcgcgcgcgcgaggaggagtggnggtggtcgtcgtcgtagttagtagtagtgtagtactactacctaactacgacgacgtaccgtaccggtacgacggtccgtcctaccacctactcgtacgacgacgtactactacaacgacgacactactagtactacgtanactaaacgtaacgaacgacgtacgtacgagtacgacgacgacgacgtactattatagtagtacgtagtaggtagggtaggggtacgggtacgggtacgtacgtcgtcggttcgttacgtacgtacggtacggtacggtacggtacg

SEQ ID NO: 313908 - DNA, 606 bp, Homo sapiens
  misc_feature: GZ8MTXP02GHC69.39.71.G05.1.454.CMB.2.raw
  modified_base (206)..(207): a, c, t, g, unknown or other
  misc_feature (206)..(207): n is a, c, g, or t
  modified_base (242)..(242): a, c, t, g, unknown or other
  misc_feature (242)..(242): n is a, c, g, or t
tcagtcgcactagtcacgaccggtgctcgatttagtgtcgtcgcaagagagagggggggaggaactgctcagttaggacccagacggaaccatggaagccccagcgcagcttctcttcctcctgctactctggctcccagatatcactggagaaaatagtgatgacgcagtctccagcccaccctctctgtgtctcgaggagaaannccacctctcctggtagggccagtcagtagtgttanctaacaacttagcctggtaccagcagaaacctgccaggttcccaggctcaatcatctatggtgcatcccaacacgggccactcggtactcccgagccctaaccctttagtcggcgaggttggggtctggggactaggagtccacgtctcaccatcaacgctaacgctagccgtacgtctagtaaagtattttagtaggttttaatttacctagtttaccaaacgtagtaactaaatacgtaactggacccttatcctaacgtttcggacggtacggggaccgtaagggtacggaagtaacttaaccgaaaacgaaacgttaggtaacgggacttacggacaccttaacgtccgttacgtttccg

SEQ ID NO: 313909 - DNA, 528 bp, Homo sapiens
  misc_feature: GZ8MTXP01DSGFS.25.82.H05.1.454.CMB.2.raw
  modified_base (233)..(233): a, c, t, g, unknown or other
  misc_feature (233)..(233): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
  modified_base (430)..(430): a, c, t, g, unknown or other
  misc_feature (430)..(430): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagagccggcctccatctcctgcaggtctagtcagaacctnatgcatagtaatggatacagctatttggattggtacctgcagaggccagggcagtcncangctcctgatctatttgcttctcacgtccgggcccgggtcctgacaaggttcngtgcagtggatcaggcacactatttcactgagcatcagcagagtggaggcggtgtaggtagttaggttaggtttagttacgtgtntagtgcgacgtcctaactaacttaaacctaccttaccgtactacttaccgttccgaccgaacggacgaacgacgtacggagtaacgttaaacgtaacg

SEQ ID NO: 313910 - DNA, 523 bp, Homo sapiens
  misc_feature: GZ8MTXP01CQ10L.25.82.H05.1.454.CMB.2.raw
  modified_base (232)..(232): a, c, t, g, unknown or other
  misc_feature (232)..(232): n is a, c, g, or t
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
  modified_base (343)..(343): a, c, t, g, unknown or other
  misc_feature (343)..(343): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtcctggccgtcacccctggagagccggcctccatctcctgcaggtctagtcagaacctnatgcatagtaatggatacagctattggattggtacctgcaggagccagggcagtcncacagctctgatctatttgcttcncacgtccggggcccgggtctgactaggttcngtggcaggtgatcagcactactattttcactgagacatcagcagagtgggaggcgtggtagggtagttggtttaggggtttattacgttggactagtgcacgcctctaacaaacctccttcgactccttaccgttcggaccgtaagggaccaacgacgtggaagtaacgttaaaacgaag

SEQ ID NO: 313911 - DNA, 557 bp, Homo sapiens
  misc_feature: GZ8MTXP01EE93H.25.82.H05.1.454.CMB.2.raw
  modified_base (234)..(234): a, c, t, g, unknown or other
  misc_feature (234)..(234): n is a, c, g, or t
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
  modified_base (404)..(404): a, c, t, g, unknown or other
  misc_feature (404)..(404): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtgttgtgctgactcagtcgccaccgtccctggccgtcacccctggagagccggcctccatctcctgcaggtctagtcagaacctnatgcatagtaatggatacagctattggattggtacctgcagaggccagggcagtctccanagctcctgatctatttggcttctcgacgtccggggcccgggtctgactaaggtcnggtgcagtggatcgaggtcactactattttcactgagcatcagacagagtagagnggtggaggtagtggtttggggtttattacgtggactagtgacgtacgcctaactaaccaaacctccttaccgtacttcccttaacccgtttccggacccgtaaacggggaccaaccggtaccgtacgggaaagtaacgtttaaaacggtaacg

SEQ ID NO: 313912 - DNA, 534 bp, Homo sapiens
  misc_feature: GZ8MTXP01D1ICR.25.82.H05.1.454.CMB.2.raw
  modified_base (235)..(235): a, c, t, g, unknown or other
  misc_feature (235)..(235): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (346)..(346): a, c, t, g, unknown or other
  misc_feature (346)..(346): n is a, c, g, or t
  modified_base (404)..(404): a, c, t, g, unknown or other
  misc_feature (404)..(404): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggcccgtcacccctggagacgccggcctccatctcctgcaggtctagtcagaacctnatgcatagtaatggatacagctattggattggacctgcaggaggccagggcagtcnccanagctctgatctattgcttcncacgtcccgggcccggtctgactaaggttcnggtgcagtggatcgaggcactactattttcacttgagctatcagcagagtagggaggngtaggaggtagttggttaggggtttattacgtgactagtgcacgtcctaactaacaaacctccttaccgactccgttaccgttcggaccgaagggaccaacgtacgtagggaataacgttaaacgtaacg

SEQ ID NO: 313913 - DNA, 577 bp, Homo sapiens
  misc_feature: GZ8MTXP01DEEZI.25.82.H05.1.454.CMB.2.raw
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
  modified_base (358)..(358): a, c, t, g, unknown or other
  misc_feature (358)..(358): n is a, c, g, or t
  modified_base (392)..(392): a, c, t, g, unknown or other
  misc_feature (392)..(392): n is a, c, g, or t
tcagactgtacagtcacgaccggtgctcgatttagtcgagctctctcgcggggctgatcaggactcctcagttcaccttctcacaatgaggctccctgctcagctccgtggggctgctaatgctctgggtctctggaaccaggtgggggtgttgtgctgactcagtcgccaccgtccctggcccgtcacccctggagacgccggcctccatctcctgcaggtctagtcagaacctcatgcatagtaatggatacagctatttggattggtacctgcaggaggccagggcagtctccanacgctcctgatcttatttggcttcncgaccgtccggggccccgggtctgactagggttcnggtgcagtggatcgagcactatattttcatgacncatcagacgagaggtaggaggtggtaggtaggttagttagggtttagggtttaattcgtagactagtcgactacgtccttaacctaaaccttaacccgttcccttaccgtaactcccgttacccgttccggaaccgaacgggaccgaaccggtacgtagggttaacgtaaacgttaaacgtaacg

SEQ ID NO: 313914 - DNA, 505 bp, Homo sapiens
  misc_feature: GZ8MTXP01C8S6J.25.82.H05.1.454.CMB.2.raw
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (346)..(346): a, c, t, g, unknown or other
  misc_feature (346)..(346): n is a, c, g, or t
  modified_base (393)..(393): a, c, t, g, unknown or other
  misc_feature (393)..(393): n is a, c, g, or t
  modified_base (447)..(447): a, c, t, g, unknown or other
  misc_feature (447)..(447): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtgttgtgctgactcagtcgccaccgtccctggccgtcacccctggagagccggcctccatctcctgcaggtctagtcagaacctcatgcatagtaatggatacagctatttggattggtacctgcagaggccagggcagtcncanagctctgatctatttggcttctcacgtccgggcccgggtctgacaaggttcngtgcagtgatcagcacactatttcactgagcatcagcagagtggagngtggaggtatggttggggtttatacgtgctatgcagcctaactaacaaactccncgtactcaccgttcggaccgaagggacaacgacgtaggacgtaacgttaaacgtaacg

SEQ ID NO: 313915 - DNA, 546 bp, Homo sapiens
  misc_feature: GZ8MTXP01CPK0E.25.82.H05.1.454.CMB.2.raw
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
  modified_base (352)..(352): a, c, t, g, unknown or other
  misc_feature (352)..(352): n is a, c, g, or t
  modified_base (411)..(411): a, c, t, g, unknown or other
  misc_feature (411)..(411): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtccacccctggagacgccggcctccatctcctgcaggtctagtcagaacctcatgcaatagtaatggatacagtctatttggattggtacctgcaggaggccagggcagtcnccangctctgatctattcgcttcncaccgtcccggggcccggtctgactaaggttcnggtgcaggtggatcgagcactactattttcactgagacatcagcgagaggtagggaggnggtaggtaggtagtttgggtttaggggtttaatacgtgacagtgactacgtcctaacctaacaaaccttccaccgtaactccacccgttcggaccgaagggacctaacgacgtacggagtaacgttaacgtaacg

SEQ ID NO: 313916 - DNA, 550 bp, Homo sapiens
  misc_feature: GZ8MTXP01DUC17.25.82.H05.1.454.CMB.2.raw
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
  modified_base (448)..(448): a, c, t, g, unknown or other
  misc_feature (448)..(448): n is a, c, g, or t
  modified_base (509)..(509): a, c, t, g, unknown or other
  misc_feature (509)..(509): n is a, c, g, or t
tcagactgtacagtcacgaccggtgctcgatttagtcgagctctctcgcggggcccagccctgggacacccagctgtttccgcttgctgatcaggactgcacacagagaacgcacccatggagttcgggctgagctgggttttccttgtcgccattttaaaaggtgtccagtgtgatgtgcaactggtggagtccgggggaaccttagttcgaccggggggtcctgagactctctgtgtgggatctggagtcgccgtgactaaatattggatgcatgggccgccaggcgccgaggggaaggggctggagtgggtctcacgtattcatcgtgatgggaccaccacaacttacgcggacctccgtagaaggccgattcacntctccagagacntcgccaacgacaccctntacttgacaaatgaacngtcttagngtacgagacgacggntgtactattctgtgcgtatgggcggctactaataacttcgggacttagtttatattatttntttaacggaatggcgtgtcggggccgtcggggaactaacgg

SEQ ID NO: 313917 - DNA, 531 bp, Homo sapiens
  misc_feature: GZ8MTXP01CC6UF.25.82.H05.1.454.CMB.2.raw
  modified_base (271)..(271): a, c, t, g, unknown or other
  misc_feature (271)..(271): n is a, c, g, or t
  modified_base (315)..(315): a, c, t, g, unknown or other
  misc_feature (315)..(315): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggcccgtcacccctggagagccggcctccatctcctgcaggtctagtcagaacctcatgcatagtaatggatacagctattggattggacccnagaggccagggcagtctccacagctcctgatctatttggcttcncacgtccccggggcccccgggtctgacaggttcagtgcagtgatcgaggcacactattttcactgagcatcagcagagtggagcgtaggggaggtagttggttaggggtttattacgtgctatgctagcctctaactaaacttcctccgacgtcctaccgttccggccgaaacggggaacaacgtaacgtaggagaacgttaaaccgaagttaagg

SEQ ID NO: 313918 - DNA, 581 bp, Homo sapiens
  misc_feature: GZ8MTXP01ETCXZ.25.82.H05.1.454.CMB.2.raw
  modified_base (233)..(233): a, c, t, g, unknown or other
  misc_feature (233)..(233): n is a, c, g, or t
  modified_base (288)..(288): a, c, t, g, unknown or other
  misc_feature (288)..(288): n is a, c, g, or t
  modified_base (354)..(354): a, c, t, g, unknown or other
  misc_feature (354)..(354): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagagccggcctccatctcctgcaggtctagtcagaacctnatgcatagtaatggatacagctattggattggacctgcagaggccagggcagtcncacagcctctgattcttagtttcgcttcgcaccggtcccggggccccggtctgaccgtaaggttcnggtgctaggtgatcgagtcactactatttcactgagcatcgagcgagtaggtagggacggtcggtagggtagggttagtttagggtttaggggtttaacttacgtgtactgtacgtcgacgtcctaactaaccttaaaccttccttaccgtacttccgttacccgttccggaccgtaacggggacctaacggtacgtagggttaacgtaaacgttaaacggtaaccg

SEQ ID NO: 313919 - DNA, 504 bp, Homo sapiens
  misc_feature: GZ8MTXP01A5UFO.25.82.H05.1.454.CMB.2.raw
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (345)..(345): a, c, t, g, unknown or other
  misc_feature (345)..(345): n is a, c, g, or t
  modified_base (396)..(396): a, c, t, g, unknown or other
  misc_feature (396)..(396): n is a, c, g, or t
  modified_base (425)..(425): a, c, t, g, unknown or other
  misc_feature (425)..(425): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccagtgggggtgttgtgctgactcagtcgccaccgtccctggccgtcacccctggagagccggcctccatctcctgcaggtctagtcagaacctcatgcatagtaatggatacagctattggattggtacctgcagaggccagggcagtcnccanagctctgatctatttgcttctcgacgtccggggccccgggtctgacaggttcngtgcagtggatcgagcacactattttcactgagcatcagcagagtggaggnggtgaggtagtggttggttagttagtgtnatgcgacgctctacaactaccttccgtactcttaccgttcgaccgaacggacgaacgacgagagtaagttaacgtaacg

SEQ ID NO: 313920 - DNA, 527 bp, Homo sapiens
  misc_feature: GZ8MTXP01BSVKB.25.82.H05.1.454.CMB.2.raw
  modified_base (235)..(235): a, c, t, g, unknown or other
  misc_feature (235)..(235): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagacgccggcctccatcctcctgcaggtctagtcagaacctnatgcatagaatggatacagctagttggattggacctgcaggagccagggcagtcnccangctctgatctatttgcttcncgaccgtcccggggcccggtcngacaggttcngtgcagtgatcagcacatatttcatganacatcagcagagtcggagnggtggagtgttgggtttagggttattcgtggatagtcgactcgcctaactaaccttaaacctcccacgtactccttaccggttccgaccgaacggggtacaacgtacgtaggaacgtaacgttaaacggtaacg

SEQ ID NO: 313921 - DNA, 730 bp, Homo sapiens
  misc_feature: GZ8MTXP01E05H6.25.82.H05.1.454.CMB.2.raw
  modified_base (236)..(236): a, c, t, g, unknown or other
  misc_feature (236)..(236): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtggggtgttgtgctgactcagtcgccaccgtccctggcccgtcaccccgtggagacgccggcctccatcctcctgcaggtctagtcagaacctnatgctatagtaatggatacagtctagtttggattcggtacctgacgaggacggccgagggctacgtcctaccacagtccttcctaggtaactttcgttagttttcggcctttccgtccgtaccccgggttcccccggggggtccccccggggttccctaggtaacccgttaacgggtttacccgaagggttcgggaccgtaagggttcggggtaaacttccggacgggtaccctaacctaaccgttttactttttacgaccgttaggacgtacctagttacccgaaggtacgaagggtaagggttaggggaacgggtcgggttaggggtaaagggttaacggtttggggttttaggggttttaacttaaccgttggaccttagttcgaccgtaccgtcccttaacctaaccgttaaaccctcccgttacctacgtaccttacccgttcggaccgtaacgggacaacgacgtaggaactaacgttaaacgtaacg

SEQ ID NO: 313922 - DNA, 546 bp, Homo sapiens
  misc_feature: GZ8MTXP01AMIEV.25.82.H05.1.454.CMB.2.raw
  modified_base (351)..(351): a, c, t, g, unknown or other
  misc_feature (351)..(351): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagagccggcctccatctcctgcaggtctagtcagaacctcatgcatagtaatggatacagtctattggattggtacctgcaggaggccagggcagtctccacagctcctgatcttatttgcttctcgacgtccggggccccgggtctgactaggttcngtggcagtggatcgaggcactactattttcactgagcatcagacgagaggtgggaggcgtaggaggtgttagggtttaggggtttattacgtgtactatcgacacgtcctaactaacaacctcccttaccgtactccttaccgttccggaccgtaacgggacaacggacgtaggaacgtaacgttaaacgtaacg

SEQ ID NO: 313923 - DNA, 618 bp, Homo sapiens
  misc_feature: GZ8MTXP01D3ZZC.25.82.H05.1.454.CMB.2.raw
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggcccgtcacccctggagacgccggcctccatctcctgcaggtctagtcagaacctcatgacataagtaatggatacagctattggattggtacctgcaggaggccagggcagtctccacagcctcctgtattcttatttcggctttctcgtaccgtccccgggggccccgggttcctggaccgtaacgggtttcaagggtcggtaccgaagggttcgggaacttcgaacgggtacctaacctacttactttttacacttgaacgactatcgagacgaggaaggtgggaggtgtaggagggttagttgggtttaggggtttaattacgtggtactagtcggactacgtccctaactaaccaaaccttcccttaccgtactccttacccggttcggaccgaacgggacgaacgtacgtaggaacgtaacgttaacgtaacg

SEQ ID NO: 313924 - DNA, 590 bp, Homo sapiens
  misc_feature: GZ8MTXP01BG07R.25.82.H05.1.454.CMB.2.raw
  modified_base (140)..(140): a, c, t, g, unknown or other
  misc_feature (140)..(140): n is a, c, g, or t
  modified_base (150)..(150): a, c, t, g, unknown or other
  misc_feature (150)..(150): n is a, c, g, or t
  modified_base (298)..(298): a, c, t, g, unknown or other
  misc_feature (298)..(298): n is a, c, g, or t
  modified_base (357)..(357): a, c, t, g, unknown or other
  misc_feature (357)..(357): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccnggtgggggtnttgtgctgactcagtcgccaccgtccctggcccgtcacccctggagacgccggcctccatctcctgccaggtctagtcagaacctcatgcatagaatggatacagtctatttggattggtacctgcagaggccgagggcagtctccanagtctctgatcttattcgcttctcgaccgtcccggggcccgggtcctgactaaggttcnggtgcagtgactcgaggtcactactacttttacncgtganacgatcgagctaggaggtgggaggcggtaggtagggtagttgggtttaggggtttaacttacgttacgtagttcgccgtacgtaccctactaaacctaaaccgttcccctaccggttactccgtaaccgttccggccgttaacgggaacctacggaaccgtaggaacgttaacgtaaacgttaacgtaacggg

SEQ ID NO: 313925 - DNA, 544 bp, Homo sapiens
  misc_feature: GZ8MTXP01DNGGH.25.82.H05.1.454.CMB.2.raw
  modified_base (236)..(236): a, c, t, g, unknown or other
  misc_feature (236)..(236): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
  modified_base (411)..(411): a, c, t, g, unknown or other
  misc_feature (411)..(411): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggcccgtcaccccgtggagacgccggcctccatctcctgcaggtctagtcagaacctnatgcatagtaatggaatacagtctatttggattggacctgcagaggccagggcagtccnccacngctctgatcttatttgcttctcgacgtccccggggccccggtctgacgtaggttcnggtgcaggtggatcgagcactacttatttcactgagcatcagacagaggtggagngtggaggtagttgggtttagggtttattacgtgactagtcgacacgtcctaactaaaccttaaacctcccttacgtactccgttaccgttcggaccgaaggacaacgacgtaggaagtaacgttaaacgaacg

SEQ ID NO: 313926 - DNA, 542 bp, Homo sapiens
  misc_feature: GZ8MTXP01DVI58.25.82.H05.1.454.CMB.2.raw
  modified_base (325)..(325): a, c, t, g, unknown or other
  misc_feature (325)..(325): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
  modified_base (461)..(461): a, c, t, g, unknown or other
  misc_feature (461)..(461): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagacgccggcctccatctcctgcaggtctagtcagaacctcatgcatagtaatggatacagctagttggattggtacctgcaggacggccagggcagtcctaccacagctcctgtatcttatttcggcttcncaccggtcccgggcccgggtcngactggttcnggtcgcagtgatcgagcactacttattttacactgagacatcagnagnggtaggaggnggtaggaggtagttgggtttcgggttattacgtggacagtgcgacnctaactaacttaacctaccttccgtactcttaccgttccgaccgaacggacgaacgacgagagtaacgttaaacgtaacgg

SEQ ID NO: 313927 - DNA, 747 bp, Homo sapiens
  misc_feature: GZ8MTXP01A0JQH.25.82.H05.1.454.CMB.2.raw
  modified_base (234)..(234): a, c, t, g, unknown or other
  misc_feature (234)..(234): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagacgccggcctccatctcctgcaggtctagtcagaacctnatgcatagtaatggatacagtctagttggattggtacctgcaggacggccagggcagtctccacagctcctgattcttagtttcgctttcgtccgtaccggtccccgggggtccccggggttcctacggtaccgtaaacgggtttcaacgggttcggaccgtagggttacgggacttcccgggaaagggtccctaaacgttaacctttaacgttttttaccaaccgttagggacgtactaacgttacgaccggacgaacgggaacgggttcggggaacgggtcggtaggggtaaacggggtttaaggtttcgggggttttaacgggggttttaaattaccggttcgtaacggttatcgggtaccctaacggtccccttaaccgtaaaccgttaaacccgttccccttacccggtaaacttaccccgttaacccggtttaccgggaacccggtaaacgggggaacctaaccgggtaccggttaagggaacgtaaacgtttaaacgggtaaccgg

SEQ ID NO: 313928 - DNA, 640 bp, Homo sapiens
  misc_feature: GZ8MTXP01BIKQC.25.82.H05.1.454.CMB.2.raw
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactgggtggagtcccgggggaaccttaggttccgacccggggggtcctgagactctcctgtgtgggatctggagtcgccgtgaactaaatntggatgcatggccnccgaggcgccgaggggaagggctggagtgggtctcacgtattcatcgtgatgggaccacacactacgcgactccggtagacgggccgtataccacctaatcctaccgagacgacactccgacccaaacgacctacccctctacttcgactaaaacgtcgaaactacggtacttaagacggttaccggaacggtaaccggaacggggttccttacggttaccctttaatttaccgtggttggccggtaagtcggggacgggtacttaacgtaacgtaaacgttccgggtattaagtttattaagttagtttacgttagaagtggtaacgtcggtcgggccgtcggaacccgtcgg

SEQ ID NO: 313929 - DNA, 564 bp, Homo sapiens
  misc_feature: GZ8MTXP01BZJA0.25.82.H05.1.454.CMB.2.raw
  modified_base (380)..(380): a, c, t, g, unknown or other
  misc_feature (380)..(380): n is a, c, g, or t
  modified_base (514)..(514): a, c, t, g, unknown or other
  misc_feature (514)..(514): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagcttgggttttccttgtcgcctattttaaaaggtgtccagtgtgatgtgcaactggtggaggtccgggggaaccttaggttccgacccggggggtcctgagactctcctgtgtgggatctggagtcgcgtgactaaatattggatgcactgggccgccgaggcgccgaggggaaggggctggagtgggtctcacgtattcatcgtgatggaccacacaactacgcgacctccgtgaaggccatcaccntctccagacgacatcgaccaacgacaccctcactgacaaatgaacagtctagagtcgagcacggctgtctatacgtgtgcgagtgggcgggtactacgtaataacgttcggggacttaggttattattagtttntttaacgggaatcgggaacgttcggtgggggcccgcggggccctaacggg

SEQ ID NO: 313930 - DNA, 547 bp, Homo sapiens
  misc_feature: GZ8MTXP01BECC1.25.82.H05.1.454.CMB.2.raw
  modified_base (150)..(150): a, c, t, g, unknown or other
  misc_feature (150)..(150): n is a, c, g, or t
  modified_base (234)..(234): a, c, t, g, unknown or other
  misc_feature (234)..(234): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (404)..(404): a, c, t, g, unknown or other
  misc_feature (404)..(404): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtnttgtgctgactcagtcgccaccgtccctggcccgtcacccctggagagccggcctccatctcctgcaggtctagtcagaacctnatgcatagaatggaatacagctatttggattggtacctgcaggagccagggcagtcnccanagctctgatctatttgcttcncacgtccgggcccgggtcngactaaggttcnggtgctagtggatcgaggcactactattttcagtgagcagtcagcagaggtggaggngtaggtaggtagttgggtttaggggtttaattacgtgtacgtagtcggtactacgtcctaactaaccttaaacctccttaccgtactccgttaccgttcggaccgaaaggacaacgtacgaggaacgtaagttaaaccgtaag

SEQ ID NO: 313931 - DNA, 565 bp, Homo sapiens
  misc_feature: GZ8MTXP01EH4IR.25.82.H05.1.454.CMB.2.raw
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (447)..(447): a, c, t, g, unknown or other
  misc_feature (447)..(447): n is a, c, g, or t
  modified_base (548)..(548): a, c, t, g, unknown or other
  misc_feature (548)..(548): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggaggtccgggggaaccttaggttccgacccggggggtcctgagactctcctgtgtgggatctggagtcgccgtgactaaatattggatgcactgggccgcaggcgccgaggggaggggctggagtgggtctcacgtattcatcgtgatgggaccacacactacgcgactccgtgaaggccatcaccntctccaganacatcgaccaacgacaccctctacttgacaaatgaactgtacttagagtacgaggacgacggntgtctattactgtgcgtatggggcggtctacgtaataacgttggggcttagttaattagttatttagtttacggaattggaaccggttcgtagggggcccncggggaaccgtaacggg

SEQ ID NO: 313932 - DNA, 707 bp, Homo sapiens
  misc_feature: GZ8MTXP01AK3XF.25.82.H05.1.454.CMB.2.raw
  modified_base (228)..(228): a, c, t, g, unknown or other
  misc_feature (228)..(228): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtggggtgttgtgctgactcagtcgccaccgtccctggccgtcaccctggagacgccgcctcatctctgcagtctagtcagaacctnatgcatagtatggatacagtctatttggattcggtacctgcgaggacggccgaaggggcagtcctacccacgacgtccttccgtgtaactttctttagttttcggccttttccgtaccgtaccccggttcccccggggggtcccccgggggttccctacgggaaccgttaaacgggtttcccgaagggttcgggaccgtaagggttgggaacttccggaacggccctaacctacttacttttttaccgaacgttcgaacgtaccacttacgaacggacgtaagggaggttaggggaacgggtcgggttagggtaagggttaggtttaggggtttttaggggtttaacttacggtgtacgtagttcggacctacgtcccttaacgtaacccttaaaccgttcccgttaccgtactccttacccgttccggaaccgtaacggaccgaacgtacgtagggttactaacgttaaacgtaacgg

SEQ ID NO: 313933 - DNA, 568 bp, Homo sapiens
  misc_feature: GZ8MTXP01D3NW7.25.82.H05.1.454.CMB.2.raw
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (413)..(413): a, c, t, g, unknown or other
  misc_feature (413)..(413): n is a, c, g, or t
  modified_base (456)..(456): a, c, t, g, unknown or other
  misc_feature (456)..(456): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgcctattttaaaaggtgtccagtgtgatgtgcaacgtggtggaggtccgggggaaccttagttcgacccggggggtcctgagactctctgtgtggatcgtggagtcgcgtgactaatatggatgcacgtgggccgcgaggcgaccgaggggaagggctggagtgggtctcgacgtattcagtcgtgagtggaccacactaactacgcggacctccgtagacggccattccaccntcncccagagacatcgaccaacgcaccctntacttgacaaatgaacagttctaagagtcgaaggacgacggtnttagtactattacgtgtgaccgtagttgggacggtctaacgtaatacgcgggtattagttattattagtttgttacggaattggaacgtcgtcgggggcctcgggaactcgg

SEQ ID NO: 313934 - DNA, 625 bp, Homo sapiens
  misc_feature: GZ8MTXP01BZHG6.25.82.H05.1.454.CMB.2.raw
  modified_base (285)..(285): a, c, t, g, unknown or other
  misc_feature (285)..(285): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgcctattttaaaaggtgtccagtgtgatgtgcaacgtggtggaggtccggggaaccttaggttccgaccggggggtcctgagactctctgtgtggatctggagtcgccgtgactaaatattggatgcactgggccncaggcgcgagggagggctggagtgggtctcagtatcagtcgtgagtcggaccacaactacttacgcggacctccggtagaacggccgaacttccgaaccaatcctaccaggacacactcgaccaacgacaccctctactgacaaatcgaaactagtacttagacgtacggaaggacgacggtcttagtaccttagttaccgtggtgtaccggtagtcgggggacggtaccttaactaaacgtaaccgttcgggggtaacttaggtttaaattaattaagtttacgttacggtaaatcgggtaacgttcgggacgggggttccgccgggaaccgtaacggg

SEQ ID NO: 313935 - DNA, 574 bp, Homo sapiens
  misc_feature: GZ8MTXP01A5Z85.25.82.H05.1.454.CMB.2.raw
  modified_base (236)..(236): a, c, t, g, unknown or other
  misc_feature (236)..(236): n is a, c, g, or t
  modified_base (361)..(361): a, c, t, g, unknown or other
  misc_feature (361)..(361): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtgttgtgctgactcagtcgccaccgtccctggccgtcacccctggagacgccggcctccatcctcctgcaggtctagtcagaacctnatgcaatagtaatggatacagtctagttggattggtacctgcaggaggcccgagggcagtcctaccacagctcctgattctattcgcttctcaccgtccggggccccgggtctgactagggttcngtggctagtggatcgaggcactacttattttcgactgacgtacatcagcagagtaggagcgggtagagggtagttgggtttagggtttattacgtgtactagtcgacacgtcctaacctaaccgaaaccttcccaccggtactcccgttaccgttccgggaccgtaaacggggacctaacgtacgtaggaaacgtaacgttaaacgtaaccgg

SEQ ID NO: 313936 - DNA, 582 bp, Homo sapiens
  misc_feature: GZ8MTXP01AUTA1.25.82.H05.1.454.CMB.2.raw
  modified_base (233)..(233): a, c, t, g, unknown or other
  misc_feature (233)..(233): n is a, c, g, or t
  modified_base (364)..(364): a, c, t, g, unknown or other
  misc_feature (364)..(364): n is a, c, g, or t
  modified_base (387)..(387): a, c, t, g, unknown or other
  misc_feature (387)..(387): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtggggtgttgtgctgactcagtcgccaccgtccctggccgtcacccctggagagccggcctccatctcctgcaggtctagtcagaacctnatgcatagaatggatacagctattggattggtacctgcagaggcccagggtcagtcctcacagctctgatctatttgcttctcaccgtccggggccccggtctgactaagggttcaagtggcaggtgtacncgagcactactatttacataganacactacgagacgaggtaggtaggaggtacgggtaggtaggtaggttagggtttagggtttagttacgtacgtacgtagtacgtacgtacgtacctaactaaccttaaacctaccgttaccgtacgtaccgttaccgttaccggaccgtaacggaacgaacggtacgtacggttaacgtaacgttaaacgtaacg

SEQ ID NO: 313937 - DNA, 806 bp, Homo sapiens
  misc_feature: GZ8MTXP01B3JTC.25.82.H05.1.454.CMB.2.raw
  modified_base (150)..(150): a, c, t, g, unknown or other
  misc_feature (150)..(150): n is a, c, g, or t
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtnttgtgctgactcagtcgccaccgtccctggcccgtcacccctggagacgccggcctccatcctcctgcaggtctagtcagaacctnatgcatagtaatggatacngtctattggattggtacctgcaggacggccagggcagtcctccacagtcctccgtagatttcttagtttcggcctttcgtccgtacccggttcccccggggggtacccccgggggttcctaggtacccgtaagggttttacccgaagggttcgggaccgtaagggttcgggaacttacggaacgggtaccctaactaactttactttttaccgaaccgttggaacggacctaacgttccgaaccgggtacgaaagggtaacgggttagggggaaacgggtccggttaaaggggtaaacgggtttaaaacggttttcggggggtttttaacgggggtttttaaattaccggttggtaaccctaaaggtccgggtacctaaccggtccccttaaaccgttaaacccgttaaaaccccgttccccttacccgggtaaacctttccccgttaaaccccgggtttcccgggaaacccggtaaaaccgggggtaccaaaccgggttaaccggtaacgggggttaaagttaaaccggtttaaaaaccggttaaccggg

SEQ ID NO: 313938 - DNA, 552 bp, Homo sapiens
  misc_feature: GZ8MTXP01B5N4C.25.82.H05.1.454.CMB.2.raw
  modified_base (151)..(151): a, c, t, g, unknown or other
  misc_feature (151)..(151): n is a, c, g, or t
  modified_base (236)..(236): a, c, t, g, unknown or other
  misc_feature (236)..(236): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
  modified_base (353)..(353): a, c, t, g, unknown or other
  misc_feature (353)..(353): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtnttgtgctgactcagtccgccaccgtccctggccgtccacccctggagacgccggcctccatctcctgcaggtctagtcagacctnatgcatagtaatggaatacagtctattggattggaccngcaggnggccagggcagtcaccanacgctctgatctatttgcttcncacggtccccggggcccggtctgactaggttcnggtgctagtggactcgagcactactattttcactgagacatcgagcgagaggtaggaggtcggtaggtagggttagtttagggtttggggtttaacttgtgtactagtggctacgtcccttaactaaccttaaacctccttaccgtactccaccgttccgacgaacgggacaacgagtacgagtaacgttaaacgtaag

SEQ ID NO: 313939 - DNA, 609 bp, Homo sapiens
  misc_feature: GZ8MTXP01EOI1I.25.82.H05.1.454.CMB.2.raw
  modified_base (393)..(393): a, c, t, g, unknown or other
  misc_feature (393)..(393): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgcccaccgtccctggcccgtcaccccgtggagacgccggcctccatcctcctgcaggtctagtcaagaacctcatgacattagtaatggatacagtctagtttggatttggtaacctgcgaggacggccagggcagtcctccacagctcctagtattcttagtttcggctttccgcgtaccccggtccccgggggtaccccgggttcctggaccgtaagggttccgnggtggcctagggtcgatcgacggactactacttattttcgactgagactactcgagcgaaggtaggtagggacggtgggtaggtagggtaagtttggggttttaggtttacttagtgtaccgagttcggacctacgcctaactaaccgaacctcccttacgactccgttacgttcgacgaacggacaacgacgtagaacgtaacgttaacgtaacg

SEQ ID NO: 313940 - DNA, 675 bp, Homo sapiens
  misc_feature: GZ8MTXP01ENTH0.25.82.H05.1.454.CMB.2.raw
  modified_base (273)..(273): a, c, t, g, unknown or other
  misc_feature (273)..(273): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
  modified_base (405)..(405): a, c, t, g, unknown or other
  misc_feature (405)..(405): n is a, c, g, or t
tcagactgtacagtcacgaccggtgctcgatttagtcgagctctctcgcggggcccagccctgggacacccagctgtttccgcttgctgataaggactgcacacagagaacgcaccatggagttcgggctgagcttgggttttccttgtcgcctaattttaaaaggtgtccagtgtgatgtgcaacgtggtggaggtccgggggtaacttaggttccggacccggggggtcctgagactctctgtgtggatcgtggagtcgcgtgactaaatnttggatgcacgtggccncaggcgcgagggagggctggngtggtctnacgttnttcagtcgtgagtcgggaccacactaacgttacggcggaactccccggtaggaacgggccattcaaaccatctccaaganacactccgacaaaccgaccacccttatacttagaactaaagtacgaaactagtcgttaaggacgtacggaaggaccgacgggggtcttgtaccttattaccgtggtagcgtaaggttcgggcgggtacttacgtaataaaccgggttcgggttattaaaggttttaatttaagttaagttttaacggttttaacgggaaagtttgggggaaccggtttcggtaccggggggacccgttacgggggtaaccccgttaacggggtttaaccg

SEQ ID NO: 313941 - DNA, 606 bp, Homo sapiens
  misc_feature: GZ8MTXP01C6T9R.25.82.H05.1.454.CMB.2.raw
  modified_base (456)..(456): a, c, t, g, unknown or other
  misc_feature (456)..(456): n is a, c, g, or t
tcagactgtacagtcacgaccggtgctcgatttagtcgagctctctcgcgggcccagccctgggacacccagctgtttccgcttgctgatcaggactgcacacagagaacgcaccatggagttcgggctgagctgggttttccttgtcgccattttaaaaggtgtccagtgtgatgtgcaacgtggtggagtccggggaaccttagttccgacccggggggtcctgagactctctgtgtggatctggagtcgccgtgactaaatattggatgcacgtgggccgcaggcgaccgaggggaggggctgggagtgggtctctacgtattcatcgtgatcgggaccaccacacgttacgcggacctccgtagaacgggccattacccgacctaatcctccgaagacgactatccgaccaacgacctaccctctacttgactaaatgaactagtcttaagngtacgacggtacacggcttagtcttattaccgtgtcgcgtagtcgggacgtcttaacgtaataacgttccggggattaggtttaatttattagttttattacgggaattgggaacgtttcggagggggttcccgcgggttcgtaaccggg

SEQ ID NO: 313942 - DNA, 572 bp, Homo sapiens
  misc_feature: GZ8MTXP01BNSNC.25.82.H05.1.454.CMB.2.raw
  modified_base (236)..(236): a, c, t, g, unknown or other
  misc_feature (236)..(236): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtgttgtgctgactcagtcgccaccgtccctggccgtcacccctggagacgcccggcctccatctcctgcaggtctagtcagaacctnatgcatagtaatggatacagtctagttggattggacctgcaggagccgagggcagtcnccanacgctctgatctattcgcttctcgaccgtcccggggccccgggtcngtacgtaaggttcnggtgcgaggtcggatcgaggaccactacttacgttttcacgtagagacatccagcgagaggtagggaggcgtagggtaggtagttgggtttagggttacttacgtgtactagtcgctacgtccctaactaacttaaaccgtccttccgtactccgttaccgttccggacgtaacgggaccaacggtaacggtaggaacgtaacgttaaacgcgg

SEQ ID NO: 313943 - DNA, 568 bp, Homo sapiens
  misc_feature: GZ8MTXP02HWE69.25.82.H05.1.454.CMB.2.raw
  modified_base (233)..(233): a, c, t, g, unknown or other
  misc_feature (233)..(233): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (355)..(355): a, c, t, g, unknown or other
  misc_feature (355)..(355): n is a, c, g, or t
tcagactgtacagtcacgaccggtgctcgatttagtcgagctctctcgcgggctgatcaggactcctcagttcaccttctcacaatgaggctccctgctcagctcctggggctgctaatgctctgggtctctggaaccaggtggggtgttgtgctgactcagtcgcccaccgtccctggcccgtcacccctggagagccggcctccatctcctgcaggtctagtcagaacctnatgcatagtaatggatacagcttatttggatttggtacctgcagaggccagggcagtcnccaacngctctgattcttattgcttcacgaccgtcccggggcccccggtctagactaggttcnggtgcagtgatcgagcactacttatttacactgagctactcgagcgagaggtagggaggtcgtaggtaggtagttagggtttagggtttagttacgtagtacgtagtagtacgacgtacctacctaacctaaacctaccctaccgtacctaccgtaccgtaccgtaccgaacggaaccgaacgtacgtacgtaacgtaacgttaaacgtaacg

SEQ ID NO: 313944 - DNA, 584 bp, Homo sapiens
  misc_feature: GZ8MTXP02JFLGX.25.82.H05.1.454.CMB.2.raw
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagagccggcctccatctcctgcaggtctagtcagaacctcatgcatagtaatggatacagctatttggattggtacctgcagaggccagggcagtcnccacngctcctgatctattgcttctcacgtccggggcccccggggtcctgacaggttcagtggcaggtggatcgaggcacactattttcactgagcatcagcagagtggaggcgtaggaggtagttgggtttagggggtttattacgtggtactagttcggtacacgtaccttacctaaacctaaaaccttcccctaacccggtaacttacccgtaacccgtttaccgggaacccgaaacggggtaccaaacggtaaccgtagggaaacgtaaacgtttaaaacgtaaaaccgg

SEQ ID NO: 313945 - DNA, 493 bp, Homo sapiens
  misc_feature: GZ8MTXP02IPFN8.25.82.H05.1.454.CMB.2.raw
  modified_base (232)..(232): a, c, t, g, unknown or other
  misc_feature (232)..(232): n is a, c, g, or t
  modified_base (293)..(293): a, c, t, g, unknown or other
  misc_feature (293)..(293): n is a, c, g, or t
  modified_base (448)..(448): a, c, t, g, unknown or other
  misc_feature (448)..(448): n is a, c, g, or t
tcagactgtacagtcacgaccggtgctcgatttagtcgagctctctcgcggggctgatcaggactcctcagttcaccttctcacaatgaggctccctgctcggctcctggggctgctaatgctctgggtctctggaaccaggtggggtgttgtgctgactcagtcgccaccgtccctggccgtcacccctggagagccggcctccatctcctgcaggtctagtcagaacctnatgcatagtaatggatacagctatttggattggtacctgcagaggccagggcagtctccanagctctgatctatttgcttctcagtccccggggcccccgggtcctgacaggttcagtgcagtggatcgaggcacactattttcactgagcatcagcagagtgaggctggagtatggttggggttatacgtgctatgcagcctactacaaactccncgactcaccttcgacaagggaacacgactagagacttaaacgatg

SEQ ID NO: 313946 - DNA, 512 bp, Homo sapiens
  misc_feature: GZ8MTXP02GT9RN.25.82.H05.1.454.CMB.2.raw
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagagccggcctccatctcctgcaggtctagtcagaacctcatgcatagtaatggatacagctattggattggtacctgcagaggccagggcagtcnccanagctcctgatctatttggcttctcacgtccggggcccccgggtcctgacgtaggttcagtgcagtgatcagcacatattttcactgagcatcaagcagagtggagctgagattgggttgggtttatacgtgtcatgcgtagccttactaacaaaccttcctaccgactcctaaccctcggaccaaagggacacgaactggaacgaacttaaaaccgaag

SEQ ID NO: 313947 - DNA, 546 bp, Homo sapiens
  misc_feature: GZ8MTXP02IZAUD.25.82.H05.1.454.CMB.2.raw
  modified_base (380)..(380): a, c, t, g, unknown or other
  misc_feature (380)..(380): n is a, c, g, or t
  modified_base (463)..(463): a, c, t, g, unknown or other
  misc_feature (463)..(463): n is a, c, g, or t
  modified_base (534)..(534): a, c, t, g, unknown or other
  misc_feature (534)..(534): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccggggaaccttagttcgacccgggggtcctgagactctcctgtgtgggatctggagtcgccgtgactaaatattggatgcactgggtccgcaggcgccgaggggaaggggctggagtgggtctcacgtattcatcgtgatgggaccaccacaactacgcggacctccgtgaagggccgattccaccntctccagagacatccgccaaacgacaccctctactgacaaatgaaacagtctagagtcgaggacacgggctagtctaattacngtgcgatgggcggctaactataacgtcgggatagttattatatttagttaggaatggacgtcgtggggccncgggacctacgg

SEQ ID NO: 313948 - DNA, 588 bp, Homo sapiens
  misc_feature: GZ8MTXP02JQ451.25.82.H05.1.454.CMB.2.raw
  modified_base (380)..(380): a, c, t, g, unknown or other
  misc_feature (380)..(380): n is a, c, g, or t
  modified_base (452)..(452): a, c, t, g, unknown or other
  misc_feature (452)..(452): n is a, c, g, or t
  modified_base (466)..(466): a, c, t, g, unknown or other
  misc_feature (466)..(466): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccgggggaaccttagttcacccggggggtcctgagactctcctgtgtgggatctggagtcgccgtgactaaatattggatgcactgggtccgccaggcgccaggggaagggctggaggtgggtcgtcacgtagtcatcgtgatgggaccaccacaacttacgcgacctccgtgagggccgattcaccntctccagagacactcgccaaacgctaacccctctacttgcaaatcgaacagtcttagagtcgaggacacggntgtctattactggngcgagtggcggtactaacttaacgtacgtcgggtactaagtttaatttacttaatttacgtttaaacggaagttacgggtaccggttacggcgggggacccggtaccgggaacccgtacggg

SEQ ID NO: 313949 - DNA, 544 bp, Homo sapiens
  misc_feature: GZ8MTXP02HB8D7.25.82.H05.1.454.CMB.2.raw
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtgttgtgctgactcagtcgccaccgtccctggccatcacccctggagacgccggcctccatcctcctgcaggtctagtcagaacctcatgcatagtaatggatacagcttattggattggtacctgcagaggccagggcagtcctcacngctccngatctatttgcttcnccacgtcccggggcccccgggtactgacgtaggttcaggtggcagtggatcgaggcacactattttcactgagcatcagcagaggtggaggcgtaggaggtagttggttaggggtttattacgtgtcgatgcacgtcctactaacaaacctccgtaccgtactacctaccgttacggaaccgaacggggacaacggtaccgtaggtaacgtaacgttaaaaccgg

SEQ ID NO: 313950 - DNA, 538 bp, Homo sapiens
  misc_feature: GZ8MTXP02IXMVG.25.82.H05.1.454.CMB.2.raw
  modified_base (375)..(375): a, c, t, g, unknown or other
  misc_feature (375)..(375): n is a, c, g, or t
  modified_base (452)..(452): a, c, t, g, unknown or other
  misc_feature (452)..(452): n is a, c, g, or t
  modified_base (518)..(518): a, c, t, g, unknown or other
  misc_feature (518)..(518): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccggggaaccttagttcacccggggggtccctgagactctcctgtgtgggatctggagtcgccgtgactaaatattggatgcactgggtccgccaggcgccgaggggaaggggctggagtgggtctcacgtattcatcgtgatggaccacacactacgcgacctccgtgaggccgattccacntctccagagacatcgccaaacgccaccctctacttgacaaatgaacagtctagatcgagacacggctgtctattacngtagcgatggcggctactatacgtgggactagttattatatttatttaggaattcggaacgttcgnggggccacggggacctacgg

SEQ ID NO: 313951 - DNA, 537 bp, Homo sapiens
  misc_feature: GZ8MTXP02HM6ZG.25.82.H05.1.454.CMB.2.raw
  modified_base (289)..(289): a, c, t, g, unknown or other
  misc_feature (289)..(289): n is a, c, g, or t
  modified_base (344)..(344): a, c, t, g, unknown or other
  misc_feature (344)..(344): n is a, c, g, or t
  modified_base (397)..(397): a, c, t, g, unknown or other
  misc_feature (397)..(397): n is a, c, g, or t
  modified_base (431)..(431): a, c, t, g, unknown or other
  misc_feature (431)..(431): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccagtgggggtgttgtgctgactcagtcgcccaccgtccctggcccgtcacccctggagagccggcctccatctcctgcaggtctagcagaacctcatgcatagtaatggatacagctattggattggacctgcagagcaggcagtctccanagctctgatctatttgcttctcacgtcccggggcccccgggtcctgacaggttcnggtgcagtgatcaggcacactattttcactgagcatcagcgagagtggaggtntggtagagttgggttaggggtttattacgttggntagtgtacgacgtacctactaacctaacctccgtacctactaccgaccgttaccggaaccgtaacggaccgaacggtacgtaggtaacgtaaacgttaaacgaacg

SEQ ID NO: 313952 - DNA, 557 bp, Homo sapiens
  misc_feature: GZ8MTXP02JTG58.25.82.H05.1.454.CMB.2.raw
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (348)..(348): a, c, t, g, unknown or other
  misc_feature (348)..(348): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccagtggggtgttgtgctgactcagtcgccaccgtccctggccgtcacccctggagagccggcctccatctcctgcaggtctagtcagaacctcatgcatagtaatggatacagctatttggattggtacctgcagaggccagggcagtcnccangctcctgatctatttgcttctcacgtcccggggcccccgggtcctgactaggttcnggtgcagtgatcgaggcacactattttcacttgagtcatcagcagaggtgggaggcgtggagggtagttgggtttaggggtttattacgtgtactagttggactacgtccttactaaccaaacctcccgtaccgacttacccacccgtttccggaaccgtaaacggggacctaacggacgttagggaactaacgttaaaaccggtaacg

SEQ ID NO: 313953 - DNA, 534 bp, Homo sapiens
  misc_feature: GZ8MTXP02HDIZZ.25.82.H05.1.454.CMB.2.raw
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtgttgtgctgactcagtcgccaccgtccctggccgtcacccctggagagccggcctccatctcctgcaggtctagtcagaacctcatgcatagtaatggatacagcttatttggattggacctgcagaggccagggcagtcnccanagctcctgattctatttggcttactcacgtcccggggcccccgggtcngaccaggttcngtgcagtgatcgaggtcacactattttcactgacgctactcgagcagagtaggaggtctaggaggtagttgggtttagggtttattacgtggctagtcgacacgtcctactaactaaacctcctacactccaccgttcggaccgaacggacacgtacgtaggaataacgttaaacgaacg

SEQ ID NO: 313954 - DNA, 572 bp, Homo sapiens
  misc_feature: GZ8MTXP02IG060.25.82.H05.1.454.CMB.2.raw
  modified_base (268)..(268): a, c, t, g, unknown or other
  misc_feature (268)..(268): n is a, c, g, or t
  modified_base (388)..(389): a, c, t, g, unknown or other
  misc_feature (388)..(389): n is a, c, g, or t
  modified_base (405)..(405): a, c, t, g, unknown or other
  misc_feature (405)..(405): n is a, c, g, or t
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggaggtccgggggaaccttagttcgacccggggggtcctgagactctcctgtgtgggatctggagtcgccgtgactaaatnttggatgcactgggtccgccaggcgccgagggaaggggctggagtgggtctcgacgtatcatcgtgatcgggacacacaactacgcgacctccgtgagggccattcacatctcagagacnncgccaacgacaccctntaacttgacaaaatcgaacagtcttaagngtacgaggacacggntgtctattacngtgcgatgggacgggcttactaatacgttcggggactaggttaatttacgtaatttatttaacgggaaattcgggaacgttcgtacgggggcccgtcggggaaccctacggg

SEQ ID NO: 313955 - DNA, 549 bp, Homo sapiens
  misc_feature: GZ8MTXP02HOLCO.25.82.H05.1.454.CMB.2.raw
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (405)..(405): a, c, t, g, unknown or other
  misc_feature (405)..(405): n is a, c, g, or t
  modified_base (448)..(448): a, c, t, g, unknown or other
  misc_feature (448)..(448): n is a, c, g, or t
  modified_base (530)..(530): a, c, t, g, unknown or other
  misc_feature (530)..(530): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccggggaaccttagttcgacccggggggtcctgagactctcctgtgtgggatctggagtcgccgtgactaaatattggatgcactgggtccgccaggcgccaggggaggggctggagtgggtctcacgtattcatcgtgatgggaccacacaacttacgcggacctccgtgaggccgattcacntcncaganacatcgaccaacgacaccctntacttgacctaaaatcgaacagtcttagagtcgagacacggtntgtctattacgtgtcgacgtagtgggcggctaacgtataacgtcgggactagtttatatattattacggaatggacgttcgnggggtccacgggtacacgg

SEQ ID NO: 313956 - DNA, 535 bp, Homo sapiens
  misc_feature: GZ8MTXP02F1CPF.25.82.H05.1.454.CMB.2.raw
  modified_base (376)..(376): a, c, t, g, unknown or other
  misc_feature (376)..(376): n is a, c, g, or t
  modified_base (405)..(405): a, c, t, g, unknown or other
  misc_feature (405)..(405): n is a, c, g, or t
  modified_base (454)..(454): a, c, t, g, unknown or other
  misc_feature (454)..(454): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccgggggaaccttaggttcacccggggggtccctgagactctcctgtgtgggatctggagtcgccgtgactaaatattggatgcactgggtccgccaggcgccagggaaggggctggagtgggtctcacgtattcatcgtgatgggaccacacacttacgcggacctcgtgaaggccgatcacntctccagagacatcgcaaacgacaccctntacttgacaaatgaacagtctagagtcgagacacggctgtactattacngtgcgatggcggctactatacgtgggcaagttattatattatttacggaatcggacgtcgtacggggccgcgggtacacgg

SEQ ID NO: 313957 - DNA, 549 bp, Homo sapiens
  misc_feature: GZ8MTXP02IWRCH.25.82.H05.1.454.CMB.2.raw
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccagtgggggtgttgtgctgactcagtcgccaccgtccctggccgtcacccctggagagccggcctccatctcctgcaggtctagtcagaacctcatgcatagtaatggatacagcttatttggattggtacctgcagaggccagggcagtctccacagctcctgattctatttgcttctcacgtccggggcccccggtctgacnggttcngtgcagtgatcagcacatatttcactgagacatcagcagagtagggaggtcgtaggaggtagttgggtttaggggtttaattacgtggtactagttgcgtacgacccttactaactaaaccttccctaccgtactaccgtaccgttccggaaccgtaacgggacctaacggacgtaggtaacgtaacgttaaacgtaacg

SEQ ID NO: 313958 - DNA, 488 bp, Homo sapiens
  misc_feature: GZ8MTXP02JZ97M.25.82.H05.1.454.CMB.2.raw
  modified_base (233)..(233): a, c, t, g, unknown or other
  misc_feature (233)..(233): n is a, c, g, or t
  modified_base (292)..(292): a, c, t, g, unknown or other
  misc_feature (292)..(292): n is a, c, g, or t
  modified_base (400)..(400): a, c, t, g, unknown or other
  misc_feature (400)..(400): n is a, c, g, or t
tcagactgtacagtcacgaccggtgctcgatttagtcgagctctctcgcgggggactgatcaggactcctcagttcaccttctcacaatgaggctccctgctcagctcctggggctgctaatgctctgggtctctggaaccagtggggtgttgtgctgactcagtcgccaccgtccctggccgtcacccctggagagccggcctccatctcctgcaggtctagtcagaacctnatgcatagtaatggatacagctattggattggacctgcagaggccagggcagtctccanagctcctgatctattgcttctcatccggggcccccgggtcctgacaggttcagtggcagtgatcaggcacactattttcactgagcatcagcagagtggagctgaggntggttagggttatacgtgcatgcagctcacaaactcctaccgatcaccgttcgaccaagggacacgactggacgtaactaacgtaacg

SEQ ID NO: 313959 - DNA, 610 bp, Homo sapiens
  misc_feature: GZ8MTXP02H9478.25.82.H05.1.454.CMB.2.raw
  modified_base (383)..(383): a, c, t, g, unknown or other
  misc_feature (383)..(383): n is a, c, g, or t
  modified_base (413)..(413): a, c, t, g, unknown or other
  misc_feature (413)..(413): n is a, c, g, or t
  modified_base (457)..(457): a, c, t, g, unknown or other
  misc_feature (457)..(457): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggaggtccgggggaaccttaggttcgacccgggggggtcctgagactctcctgtgtgggatctggagtcgccgtgactaaatattggatgcactgggtccgcaggcgccgaggggaaggggctggagtgggtctcacgtattcatcgtgatgggaccaccacaacttacgcggacctccgtgaggccgattcaccntctccagagacatccgccaaacgcaccctntacttgacaaatgaaactgtacttagagtacgaggacacgggtntgtactattactggtgacgtagtgggacgggtaccttaacgtaactaaaccggtccggggataaaggtttaattattaattttaagtttaacggggaaattcggggtaaaccgtttcggtcggggggcccgaccgggggtaacccgtaacggg

SEQ ID NO: 313960 - DNA, 550 bp, Homo sapiens
  misc_feature: GZ8MTXP02H5PYY.25.82.H05.1.454.CMB.2.raw
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
  modified_base (355)..(355): a, c, t, g, unknown or other
  misc_feature (355)..(355): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgcccaccgtccctggccgtccacccctggagagccggcctccatctcctgcaggtctagtcagaacctcatgcatagtaatggatacagcttatttggattggtacctgcagaggccagggcagtctaccanacgctcctgattctatttgcttcncacgtcccggggcccccggtctgactaggttcngtgcagtgatcgaggccacgtactattttcacttgagactatcagcgagaggtgggagcgtaggaggtagtggtttacggggtttattacgtgtcagtcgacgtacgtacctactaacctaaactcccgtaccgactcctaaccgttcgaaccgtaacggacgaacgacttaggaacgtaactttaaaacggacg

SEQ ID NO: 313961 - DNA, 552 bp, Homo sapiens
  misc_feature: GZ8MTXP02HVPQ1.25.82.H05.1.454.CMB.2.raw
  modified_base (320)..(320): a, c, t, g, unknown or other
  misc_feature (320)..(320): n is a, c, g, or t
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
  modified_base (405)..(405): a, c, t, g, unknown or other
  misc_feature (405)..(405): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggcccgtcacccctggagagccggcctccatctcctgcaggtctagtcagaacctcatgcatagtaatggatacagcttatttggattggtacctgcagaggccagggcagtctccacagctcctgatcttatttggcttcncacgtccgggcccccgggtccngactggttcnggtgcagtggatcaggcacactattttcactgagtcatcagcagagtggaggntggtaaggtgttgggtttaggggtttattacgtggtactagtcggcacgtacctactaactaaacctccctaccgtaactccgtaacccgttccggaccgaaacggggaccaacggtacgtaggaacgtaaagtttaaaacgtaacg

SEQ ID NO: 313962 - DNA, 595 bp, Homo sapiens
  misc_feature: GZ8MTXP02GN6E5.25.82.H05.1.454.CMB.2.raw
  modified_base (585)..(585): a, c, t, g, unknown or other
  misc_feature (585)..(585): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccggggaaccttagttcgacccggggggtccctgagactctcctgtgtgggatctggagtcgccgtgactaaatattggatgcacgtgggtccgccgaggcgccgaggggaagggctggaggtgggtctcacgtattcatcgtgatcgggaccacacaacttacgcggacctccgtgacggccgattccaccatcctccagacgacacgtccgacccaaacgacctacccctctaacttgaaccaaaatcgaaactagttaccttaaggacgttacggaaacggaccaacggggtcttggttaccttagttaccgtggtagcgaagtcggacgggtctactaatacgtcgggactagttattatattagttacgaagtggacgtcgtcgggcncggactacgg

SEQ ID NO: 313963 - DNA, 713 bp, Homo sapiens
  misc_feature: GZ8MTXP02J31O3.25.82.H05.1.454.CMB.2.raw
  modified_base (148)..(148): a, c, t, g, unknown or other
  misc_feature (148)..(148): n is a, c, g, or t
  modified_base (232)..(232): a, c, t, g, unknown or other
  misc_feature (232)..(232): n is a, c, g, or t
  modified_base (413)..(413): a, c, t, g, unknown or other
  misc_feature (413)..(413): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccagtggggtnttgtgctgactcagtcgccaccgtccctggccgtcacccctggagagccggcctccatctcctgcaggtctagtcagaaccctnatgactagtagtaagtggaactacgagtacttagttggtacgttcggtacctgacgaggacggccgaggtcctacgtcctaccacgtacgtccttcctagtacttcttacgtttcgtccttccgtaccggtaccccgggtcccccggggtcccccggtaccgtacggtacgtacggttcgnggtcggtacgtaggtacgtacgtacgacgtacctaacttaactttactttaccgaacgtacgacgtacgtacgtacgacgtacgtaggtagggtacgggtacggtacggtaggtaggttaggtttagggtttacgggtttacgttacgttacgtacgtacgtacgtaccgtaccgtaccgttaaccgtaaaccctaaacccgtacccgtacccgtaccgtacccgtacccgtaacccggtaaccggtaaccggtaaccgtaaccgtaacggtaacggtaaacgtaaacgtaaacgtaacg

SEQ ID NO: 313964 - DNA, 610 bp, Homo sapiens
  misc_feature: GZ8MTXP02JW2KJ.25.82.H05.1.454.CMB.2.raw
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagacgccggcctccatcctcctggcgggtctagtcagaacctcatgcatagtaatggatacagctattggattggtacctgcaggaggccaggggcagtcctccacagctcctgtattcttatttggcctttctcgtacgtcccccggggccccccggggtcctcgacgtacggttcaggtgggcgaggtggatcgaggccaactacttactttttcacgttagacgctatccagacgaggtaggtgggaggtcgtggagggtagtttgggtttagggggttttatacgtgtacgtagtcgacacgtcctacgtaacctaaacctcccgtaccgtacgtccctaccgttacccggaccggaaacgggtaaccgacggtacgtacgggaacgtaaacgttaaaaccggaacttcgggg

SEQ ID NO: 313965 - DNA, 533 bp, Homo sapiens
  misc_feature: GZ8MTXP02JT5DN.25.82.H05.1.454.CMB.2.raw
  modified_base (377)..(377): a, c, t, g, unknown or other
  misc_feature (377)..(377): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccggggaaccttagttcacccggggggtccctgagactctcctgtgtgggatctggagtcgccgtgactaaatattggatgcactgggtccgcaggcgccagggaggggctggagtgggtctcacgtattcatcgtgatgggaccaccacaacttacgcggacctccgtgaagggccgattcacntctccagagacatcgccaaacgacaccctctactgcaaatgaacagtcttagagtacgagacacggctgtctattactgtgcgatggcggctactagtaactgggacagttatatattattacggaatcggacgtctggggccgcggggactacgg

SEQ ID NO: 313966 - DNA, 584 bp, Homo sapiens
  misc_feature: GZ8MTXP02GZE6U.25.82.H05.1.454.CMB.2.raw
  modified_base (304)..(304): a, c, t, g, unknown or other
  misc_feature (304)..(304): n is a, c, g, or t
  modified_base (357)..(357): a, c, t, g, unknown or other
  misc_feature (357)..(357): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtgttgtgctgactcagtcgccaccgtccctggcccgtcacccctggagagccggcctccatctcctgcaggtctagtcagaacctcatgcatagtaatggatacagctatttggattggtacctgcagaggccagggcagtctccacagcctccngattctatttggcttctcacgtcccggggcccccgggtcctgacgtaggttcnggtggcagtgatcgaggcacactattttcacttgagacatcagacagagtggaggcgtgggaggtagttgggtttagggggtttaatttacgtggtacgtagttggactacggtaccctactaacctaaacctccctaccggtaacttcccgtacccgtttacgggaccgaaacgggtaaccgaaccggtaccgttagggaaacgtaaagtttaaaaccggtaacgg

SEQ ID NO: 313967 - DNA, 557 bp, Homo sapiens
  misc_feature: GZ8MTXP02GB8PO.25.82.H05.1.454.CMB.2.raw
  modified_base (233)..(233): a, c, t, g, unknown or other
  misc_feature (233)..(233): n is a, c, g, or t
  modified_base (297)..(297): a, c, t, g, unknown or other
  misc_feature (297)..(297): n is a, c, g, or t
  modified_base (347)..(347): a, c, t, g, unknown or other
  misc_feature (347)..(347): n is a, c, g, or t
  modified_base (390)..(390): a, c, t, g, unknown or other
  misc_feature (390)..(390): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggcccgtcacccctggagagccggcctccatctcctgcaggtctagtcagacctnatgcatagtaatggatacagtctatttggatttggtacctgcaggaggccagggcagtctccanagctctgatctattgcttctcacgtccgggcccccggtctgacaggttcngtgcagtgatcgagcactacttatttcactgagcatcagcagngtaggaggctaggaggtattagggtttagggtttattacgtgacgtagtcgacgtacgtacccttactaaacctaaaccttcccgtaccgtacttacccgtaccgttaccggaccgtaaacgggtaccgaacggtacgtaggaaacgtaacgttaaaacccgtaacg

SEQ ID NO: 313968 - DNA, 568 bp, Homo sapiens
  misc_feature: GZ8MTXP02GCVDW.25.82.H05.1.454.CMB.2.raw
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (478)..(478): a, c, t, g, unknown or other
  misc_feature (478)..(478): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggaggtccggggaaccttaggttccgacccggggggtcctgagactctcctgtgtgggatcgtggagtcgcgtgactaaatattggatgcacgtgggtccgccgaggcgccgaggggaaggggctggagtgggtctcgacgtattcatcgtgatcggaccaccacaacgtacgcgaccctccgtagaaggccattccacntctccaganacatcgccaaacgccaccctctactgacaaaatcgaaactagtcttaagagtacggaaggccacggcttgtacttaattacngtgcgagtcgggcggtctaacgtactaacgtcgggacttagttattactatttagttaacgaagttggacgtgtcgggccgacggacacg

SEQ ID NO: 313969 - DNA, 596 bp, Homo sapiens
  misc_feature: GZ8MTXP02I7SO1.25.82.H05.1.454.CMB.2.raw
  modified_base (291)..(291): a, c, t, g, unknown or other
  misc_feature (291)..(291): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagagccggcctccatctcctgcaggtctagtcagaacctcatgcatagtaatggatacagcttattggattggtacctgcagaggccagggcagtccnccacagctcctgattcttatttggcttctcaccgtcccggggcccccgggtccngacaggttcnggtgcagtgatcgaggcacactattttcactgagcactcagacgaggaggttagggagggtacgtaggtagggtagtttggggttttagggggtttaatttaccgtgtcgtagttcggactaacggcccttacctaaacctaaacccttccctacccgtaactacccgtaacccgttaccgggaaccgtaaacgggaaccgaacggtaaccgtaggaaacgtaaacgtaaaacgttaacgg

SEQ ID NO: 313970 - DNA, 495 bp, Homo sapiens
  misc_feature: GZ8MTXP02GKI4R.25.82.H05.1.454.CMB.2.raw
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (419)..(421): a, c, t, g, unknown or other
  misc_feature (419)..(421): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccagtgggggtgttgtgctgactcagtcgccaccgtccctggccgtcaccccgtggagagccggcctccatctcctgcaggtctagtcagaacctcatgcatagtaatggatacagctattggattggtacctgcagagccagggcagtctcacagctccngatcttattgcttctcacgttccggggcccccggtctggacaggttcngtgcagtgatcgagcacatatttcactgagcatcagcagagtggaggngngagtagtggttggttagtagtgnnngcgacgactactactactactactactactaccgtacgacgaacgacgacgacgagacgtaacgtaacgtaacg

SEQ ID NO: 313971 - DNA, 564 bp, Homo sapiens
  misc_feature: GZ8MTXP02IBQS1.25.82.H05.1.454.CMB.2.raw
  modified_base (233)..(233): a, c, t, g, unknown or other
  misc_feature (233)..(233): n is a, c, g, or t
  modified_base (428)..(428): a, c, t, g, unknown or other
  misc_feature (428)..(428): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtcctggccgtcacccctggagacgccggcctccatctcctgcaggtctagtcagaacctnatgacatagtaatggatacagcttattggattggacctgcagacggccagggcagtctccacagctcctgacttctagttcggcttcgcacgtccccggggcccccggggttcctaggaccgtaggttcaggtggctaggtgaatcgagccactactatttttcactgacgcatcgagacgaggaagtgggaagngtaggtaggtagttagggttagggtttagttacgtagtgtagtagtcgacgacctactaactaaacctacctaccgtactacctaccgttacgaccgaacggacgacgacgacggtacgtaacgtaaacgtaacgg

SEQ ID NO: 313972 - DNA, 588 bp, Homo sapiens
  misc_feature: GZ8MTXP02G1LTJ.25.82.H05.1.454.CMB.2.raw
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccagtgggggtgttgtgctgactcagtcgccaccgtccctggcccgtcacccctggagagccggcctccatctcctgcaggtctagtcagacctcatgcatagtaatggatacagctattggattggacctgcagagccaggcagtcncangctcngatctattcgcttctcaccgtccggggcccccgggtctgacgtaggttcaggtggcaggtggatcgaggacactacttattttcacgtggaatcatccgagtacgagtacggtgggacggtgtagggtaggtagttgggtttagggggtttattcggcttaggctagtgacacggtcccttacgtaaacctaaaccttcccgtaccgtacgttacccgtacccggtttacgaaccccgtaaacggggaaccgtaaccggtaccggtaacgggtaacgtaaacgtttaaaaccgg

SEQ ID NO: 313973 - DNA, 644 bp, Homo sapiens
  misc_feature: GZ8MTXP02HDPRF.25.82.H05.1.454.CMB.2.raw
  modified_base (240)..(240): a, c, t, g, unknown or other
  misc_feature (240)..(240): n is a, c, g, or t
  modified_base (310)..(310): a, c, t, g, unknown or other
  misc_feature (310)..(310): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtgttgtgctgactcagtcgccaccgtccctggcccgtccaccccgtggagacgcccggcctccatcctcctgcaggtctagtcagaacctnatgcatagtaatggatacagtcttattggattggtacctgcaggacggccgagggcagtcctaccaacgngccttcctgtacttctttagtttcggcctttacgtccgaccccgttccccgggggccccccggggttccctaggtaccgtacgggtttcgagggttcgggacgtaaggttcggattccggacgggtaccaactacctttactttttcacgttagacgtactactaccgaagcgaaggaggtacggggaggtcgtagggtaagggttagttggggtttacggtttagttacgtgacgtgttcgacgtacgaccttacgaactaacctccgtacactaccgtacccgtacggacgaacgggtaccaacggtacgtaggacgtaacttaaacgaacg

SEQ ID NO: 313974 - DNA, 540 bp, Homo sapiens
  misc_feature: GZ8MTXP02H9AHH.25.82.H05.1.454.CMB.2.raw
  modified_base (233)..(233): a, c, t, g, unknown or other
  misc_feature (233)..(233): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagacgccgcctccatctcctgcaggtctagtcagaacctnatgcatagtaatggatacagcttattggattggacctgacagaggcagggcagtcnccangctcngtattctattcgctctcgaccgtccccggggcccccggtcngactaggttcngtgggacnggtgatcgagccactactattttcactgagtcatcagacgagagtggagcgtggtaggtagtttgggttaggtttatacgtgcagtgcacgtcctactaacctacctacctaccgacttaccgaccgttaccgaccggaaacggaccgaacgacgtaggtaacgtaaacgtttaaacgacgg

SEQ ID NO: 313975 - DNA, 682 bp, Homo sapiens
  misc_feature: GZ8MTXP02HCF1G.25.82.H05.1.454.CMB.2.raw
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtgttgtgttgactcagtcgccaccgtcctggccgtcaccctggagagccggcctcatctcctgcaggtctagtcagaacctnatgacatagtaatgatacatntagttggattcggtaccngacgaggacggcgaggcagtctaccacgagctctagtattcttagttcggtcttcgtcgaccggtccccccggggtaccccccgggtcctacggacgtaggttcgagggtcggacgaggtacgacgtacgaggacctaactaacttacttttaccgaacgtagtacgactacgtacgaacgacgaaggtaggtagggagggtacggtaggtaagggttaaggttagggtttaggggtttaagtttacgttacgtacgtacgtacgtacgtacgtaccgtaacctaaacctaaaaccgttacccgtacccgtaaccgttaaccgtaacccgttacccggtaaccggaaacgggaaaccggtaaccgtaacgtaacggtaaacggtaaaacgttaaaacggtaaaacggtacgg

SEQ ID NO: 313976 - DNA, 549 bp, Homo sapiens
  misc_feature: GZ8MTXP02JO0GL.25.82.H05.1.454.CMB.2.raw
  modified_base (265)..(265): a, c, t, g, unknown or other
  misc_feature (265)..(265): n is a, c, g, or t
  modified_base (372)..(372): a, c, t, g, unknown or other
  misc_feature (372)..(372): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttcctgtcgccattttaaaaggtgtccagtgtgatgtgcaactggtggagtccggggaaccttagttcgacccggggggtcctgagactctcctgtgtgggatctggagtcgccgtgactaaatnttggatgcactgggtccgcaggcgccgaggggaaggggctggagtgggtctcacgtatcatcgtgatggacacacactacgcgaccctcgtagaaggccgatcaccntctaccagagacatccgaccaaacgccaaccctctacttgaacaatcgaactagtacttagagtcgaacggacacggctagtctaaattctgtgcgtatcgggcggctaaggtactacgcgggacttagttattatattagttaggaatggtacgtcgagggccgacgggactacgg

SEQ ID NO: 313977 - DNA, 603 bp, Homo sapiens
  misc_feature: GZ8MTXP02HCS2T.25.82.H05.1.454.CMB.2.raw
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtggggtgttgtgttgactcagtcgccaccgtccctggccgtcaccctggagagccggcctccatctcctgcaggtctagtcagaacctcatgcatagtaatggatacagcttagttggattggtacctgcagaggccagggcagtctcacagctctgattctatttggcttctacgacggtcccccggggccccccggggtcctagaccgtagggttccaggtcggactaggtggactcgaggactactacttattttcactgagctatcagacaggagtggagtcgtaggagggttagttagggtttaggggtttacttacgtgacgtagtcgactacgtccctaacctaaactaaaccgttccctaccggtacttacccgtaaccgttacgggaacccgaaacggggaacctaaccggaacgttacgggaaagttaaactaaaaccggtaacgtcggg

SEQ ID NO: 313978 - DNA, 550 bp, Homo sapiens
  misc_feature: GZ8MTXP02IX90C.25.82.H05.1.454.CMB.2.raw
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (395)..(395): a, c, t, g, unknown or other
  misc_feature (395)..(395): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccagtgggggtgttgtgttgactcagtcgccaccgtccctggccgtcacccctggagagccggcctccatctcctgcaggtctagtcagaacctcatgcatagtaatggatacagcttatttggattggtacctgacagaggccagggcagtcnccangctcngatctatttcggcttcncacgtccccggggcccccgggtctgactaggttcagtgggcaggtggatcgaggcaactactatttttcactggacntatcagcagagtaggagcgtaggaaggtgttgggtttaggggtttattacgtggactagtgctagtcctactaactaaacctcctacgtactccgtaccgttacggaccgaaacggaaccgtaacgacgtaggaagtaacgttaacgaacgttgg

SEQ ID NO: 313979 - DNA, 647 bp, Homo sapiens
  misc_feature: GZ8MTXP02HPGDQ.25.82.H05.1.454.CMB.2.raw
  modified_base (141)..(141): a, c, t, g, unknown or other
  misc_feature (141)..(141): n is a, c, g, or t
  modified_base (313)..(313): a, c, t, g, unknown or other
  misc_feature (313)..(313): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccnggtgggggtgttgtgctgactcagtcgccaccgtcccgtggcccgtccaccccgtggacgacgcccggcctccatcctcctgcaggtctagtcagaacctcatgacatagtaatggatacagcttagttggatttggtacctgacaggacggccaggggctagtcctaccanagcctctagtacttctatttcggcctttacgcgaccggtccccggggcccccgggttctcggaacgttggttcagggttcggataacggtggactcgagtacaactacttacttttacaggttagacgtactacgtacgagacggaggtaggtacgggtacggtacggtagggtaggttagggtttagggtttagggtttagtttacgtacgtacgtacgtacgtacgtacgtaccgtacctaacctaacctaccgtaccgtaccgtaccgtaccgtaccggtaaccggaacggtacgtacgtacgtaacgtaacgtaaacgttaaacgtaacg

SEQ ID NO: 313980 - DNA, 588 bp, Homo sapiens
  misc_feature: GZ8MTXP02FJKIO.25.82.H05.1.454.CMB.2.raw
  modified_base (391)..(391): a, c, t, g, unknown or other
  misc_feature (391)..(391): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccgggggaaccttagttcgacccggggggtccctgagactctcctgtgtgggatctggagtcgccgtgactaaatattggatgcacgtgggccgccagggcgccgaggggaaggggctggagtgggtctcacgtattcatcgtgagtgggaccaccacaacttacgcggacctccgtagaagggccgattcaccatccncagagacatccgaccaaacgacaccctntactgacaaangaaacagtctagagtcgagacacggctgtactatactgtgcgagtgggcggtactacgtaagtaaccgtgggtactagtttaacttattaacgtttagtttaaacggaaagtttcgggaaccggttcggtgggggacccggacggggaccctaacggg

SEQ ID NO: 313981 - DNA, 573 bp, Homo sapiens
  misc_feature: GZ8MTXP02FYX5B.25.82.H05.1.454.CMB.2.raw
  modified_base (150)..(150): a, c, t, g, unknown or other
  misc_feature (150)..(150): n is a, c, g, or t
  modified_base (353)..(353): a, c, t, g, unknown or other
  misc_feature (353)..(353): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtnttgtgctgactcagtcgccaccgtccctggccgtcacccctggagacgccggcctccatctcctgcaggtctagtcagaacctcatgcatagtaatggatacagtctaattggattggtacctgcagaggccagggcagtctccacagctctgatcttatttgcttctcacgtcccggggcccccggtctcgacgtaggttcnggtgcaggtgatcgaggcacgtacttattttaccaacttgacgtcacgtcaagcgaagaggtagggaggtcgtagggtaggtagttagggtttaggggtttattagtgtcgtagtgctacgtacctactaaacctaaacctcccgtacccgacttacccgtacccgttaccggaaccgaacggggaccacggacgtacgaagtaacgtaaaaccgtacgg

SEQ ID NO: 313982 - DNA, 634 bp, Homo sapiens
  misc_feature: GZ8MTXP02GA6C2.25.82.H05.1.454.CMB.2.raw
  modified_base (150)..(150): a, c, t, g, unknown or other
  misc_feature (150)..(150): n is a, c, g, or t
  modified_base (388)..(388): a, c, t, g, unknown or other
  misc_feature (388)..(388): n is a, c, g, or t
  modified_base (509)..(509): a, c, t, g, unknown or other
  misc_feature (509)..(509): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtnttgtgctgactcagtcgccaccgtccctggccgtcacccctggagacgccgcctccatctcctgcaggtctagtcagaacctcatgcatagtaatggatacagtcttagtttggattcggtacctgcgagacggccgaggggctagtcctccaacagtcctccgtgacttcgtttagtttcggcttccgtacgtaccggtcccccgggggtccccccgggtcctacggactaggttcngggttcggctaaggtcggatcgagggtccaacgtacttacttttcacttagagtacagtcctaagactagaacggtgggagtcgtaggtaggtagttggggtttaggttacttagtcggtntagttgaccgtacgtacccttactaaacctaaacccgttccgtaccgtactacccgttaccggttaccggaaccgtaacggaccgtacggtaacgtacggtaaactaaaccgtaaacgttaccgg

SEQ ID NO: 313983 - DNA, 556 bp, Homo sapiens
  misc_feature: GZ8MTXP02JRNVT.25.82.H05.1.454.CMB.2.raw
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccagtgggggtgttgtgctgactcagtcgccaccgtccctggccgtcacccctggagagccggcctccatctcctgcaggtctagtcagaacctcatgcatagtaatggatacagctattggattggacctgcagagcaggcagtctcacagctcctgatctatttgcttactcacgtccggggcccccgggtcctcggacacgggttcaggtcgggctagtgggactcgagggccacgtacttattttcacttagagcactcaagcgagnggtaggacggngtggtaggtagttggtttagggtttagtttacgtgtagtagtagtcgtacgctactacctaaacctacctaccgtactaccgtacccgttaccgaccgaacggacgacgacgtacggagtaacgtaaacgtaaacgg

SEQ ID NO: 313984 - DNA, 614 bp, Homo sapiens
  misc_feature: GZ8MTXP02GSMGF.25.82.H05.1.454.CMB.2.raw
  modified_base (295)..(295): a, c, t, g, unknown or other
  misc_feature (295)..(295): n is a, c, g, or t
  modified_base (350)..(350): a, c, t, g, unknown or other
  misc_feature (350)..(350): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtgttgtgctgactcagtcgccaccgtcctggccgtcaccctggagacgccggcctccatctcctgcaggtctagtcagaacctcatgcaatagtaatggatacagctatttggattggtacctgcagaggccagggcagtctcacngctctgatcttattggcttctcacgtccgggcccccgggtctcgacgtaggttcnggtgctaggtcgatcgaggcactactacttttcacgtgacgactatcacgacgagaggtggacggtcgtagggaggtagttaggggtttaggggtttaactttaacgtggtacgtaagttcggtacacgtacccttaccgtaaacctaaaccgttaccctacccgtaaacttcccgttaacccgttaccgggaaaccgtaaacggggtaaccgaaccggtaaccgttaggggaaacctttaaaacggtaaaaccggtaaaccgg

SEQ ID NO: 313985 - DNA, 777 bp, Homo sapiens
  misc_feature: GZ8MTXP02JV2DJ.25.82.H05.1.454.CMB.2.raw
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtgttgtgctgactcagtcgccaccgtccctggccgtcaccctggagacgccggcctcatctcctgcaggtctagtcacgaacctcatgcatagtaatggaatacagcttagttggattcggacctgctagacggccgtagggctagtcctaccgaacgacgtcctaccgtgtacttccgttagtttccggtcctttcgtaccgaccccgggttcccccgggggtcccccccggggttcctaggaccgttaacggttccgtaggggtcggacgtagggtacggtacgtacggaacggtcctaaactacctttaactttttccaacgttacggaacgacttacgtacgaacggacgaaggtagggttacgggaacgggtcggttaggggtaaggtaagggttttgggggttttaaggggtttaaactttaccggttgtaacgtacgtttacggacgttaaccggtaccctttaaccgtaaaaccttaaaccccggttaccttaccccggtaaaaccttccccggttaaacccggttaccccgggtaaaccgggaaaaccggggacctaaacccgggttaaaccggtaaaagggtaacggtttaaaaaccggtaaaaccgggtttaaccgg

SEQ ID NO: 313986 - DNA, 686 bp, Homo sapiens
  misc_feature: GZ8MTXP02I7O3I.25.82.H05.1.454.CMB.2.raw
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagacgccggcctccatctcctgcaggtctagtcagaacctcatgcatagtaatggatacagcttagttgattgacctgcagaggccagggcagtcnccaangctcctgtactcttagtttcgctttctcgaccgtccccggggcccccggggttcctaggacgtacgggtttacaggggtcggactaagggttcggaactaccggaagggtccctaaacctacctttaaacttttttaccgaacccgtttaggaaccgtactaacgttaccgtaaacgaccgaaagggtacgggttagggggaaaggtccggtaggggtaggggttaaggtttacgggggttttaggggttttaaccgttaacgttcgacgtaagttcggactacggacccttacgtaaacctaaacccttcccgtacctaactccgtaacccgttcggaaccgaaacgggactaacgaacgttaggaaacgttaaacgttaaacggtaacgg

SEQ ID NO: 313987 - DNA, 567 bp, Homo sapiens
  misc_feature: GZ8MTXP02G524P.25.82.H05.1.454.CMB.2.raw
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcacccctggagacgccggcctccatctcctgcaggtctagtcagaacctcatgcatagtaatggatacagctatttggatttggtacctgcagaggcagggcagtcnccangctccngatctatttgcttctcacgtcccgggccccggtcngacagttcngtgcaggtgatcgaggcactacttnttttcacgttgagctactcagacgaggtaaggtgggaggtcctagggagggttagttaggggtttaggggtttacttacgtgtacgtagtcgacgtacgtccctactaacctaaacctcccgtaccgtactaccgtacccgttaccggaaccgaacgggaaccacggtacgtaggaacgtaacgttaaaacggtacg

SEQ ID NO: 313988 - DNA, 570 bp, Homo sapiens
  misc_feature: GZ8MTXP02FQVCT.25.82.H05.1.454.CMB.2.raw
  modified_base (356)..(356): a, c, t, g, unknown or other
  misc_feature (356)..(356): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggcccgtccacccctggagagccggcctccatcctcctgcaggtctagtcagaacctcatgcatagtaatggatacagtctattggattggtacctgcagaggccagggcagtctcacagctcctgatcttattcgcttctcgaccgtcccggggcccccgggtctggacgtggttcnggtgctaggtggatcgaggccactacttattttacactgacgcatcagacagaggtaggagcgtaggaggtagttaggtttaggggtttaattagtggactagtcgacgtacgtccctactaacctaaaccttccgtaccgtactacccgtacccgttaccggaaccgaaacgggacgaacggacgtaggtaacgtaaacgttaaacgtaacgg

SEQ ID NO: 313989 - DNA, 568 bp, Homo sapiens
  misc_feature: GZ8MTXP02H2J2J.25.82.H05.1.454.CMB.2.raw
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggcccgtccacccctggagacgccggcctccatcctcctgcaggtctagtcagacctcatgcatagtaatggatacagcttatttggattcggtacctgcaggacggccgagggcagtctccangctcngattcttatttcgcttctcgaccgtcccggggccccccggggtctggacgtaggttcnggtgcaggtgatcgagcactactattttacacgtgagtcatcagacgagaggtgggaggtcgtaggaggtagttgggtttagggtttacttagtgtacgagttcgacgtacgtacccttacgtaacctaaacctccctaccgtactccgtacccgttccggaccgaacggactaacgacgtaggaacgtaacgttaaacgacg

SEQ ID NO: 313990 - DNA, 574 bp, Homo sapiens
  misc_feature: GZ8MTXP02JTEY7.25.82.H05.1.454.CMB.2.raw
  modified_base (289)..(289): a, c, t, g, unknown or other
  misc_feature (289)..(289): n is a, c, g, or t
  modified_base (466)..(466): a, c, t, g, unknown or other
  misc_feature (466)..(466): n is a, c, g, or t
  modified_base (481)..(481): a, c, t, g, unknown or other
  misc_feature (481)..(481): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggaggtccggggaaccttaggttccgaccccggggggtcctgagactctcctgtgtgggatctggagtcgccgtgactaaatattggatgcacgtgggtccnccgaggcgccgaaggggaaggggctggagtgggtctcgacgtattcatcgtgatcggaccaccaacaactacgcgacctccgtagaacgggccattccaccatcctcgagagacacgtccgacccaaacgaccacccctctacttgactaaatgaactagtctagagtacgagaacncggctgtctattacnggtgcgagtgggcggtactacgtactaacgtgggactagtttatatactttagttacgaagtcggtacgtcgtaggggcccgtcggactacgg

SEQ ID NO: 313991 - DNA, 556 bp, Homo sapiens
  misc_feature: GZ8MTXP02F1WAC.25.82.H05.1.454.CMB.2.raw
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
  modified_base (347)..(347): a, c, t, g, unknown or other
  misc_feature (347)..(347): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggcccgtcacccctggagagccggcctccatctcctgcaggtctagtcagaacctcatgcatagtaatggatacagtctatttggattggtacctgcagaggccagggcagtcnccanagctctgatcttattgcttcncacgtccggggcccccggtctgacagttcnggtgcaggtgatcgaggcactactattttcactgagcatcgaagcgagagtgggacggcgtaggaggtagttgggtttacggggtttaattacgtgtacgtagtgactacgtccctactaacctaaacctccctaccgacttaccgtaccgttacggaccgaaacgggaccaaccggtacgtaggaaacgtaaacttaaaccggtaacg

SEQ ID NO: 313992 - DNA, 579 bp, Homo sapiens
  misc_feature: GZ8MTXP02HC4JF.25.82.H05.1.454.CMB.2.raw
  modified_base (321)..(321): a, c, t, g, unknown or other
  misc_feature (321)..(321): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
  modified_base (453)..(453): a, c, t, g, unknown or other
  misc_feature (453)..(453): n is a, c, g, or t
  modified_base (502)..(502): a, c, t, g, unknown or other
  misc_feature (502)..(502): n is a, c, g, or t
  modified_base (557)..(557): a, c, t, g, unknown or other
  misc_feature (557)..(557): n is a, c, g, or t
  modified_base (566)..(566): a, c, t, g, unknown or other
  misc_feature (566)..(566): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagcttgggttttccttgtcgccattttaaaaggtgtccagtgtgatgtgcaactggtggagtccggggaaccttagtccgaccggggggtcctgagactctctgtgtggatctggagtcgcgtgactaaatattggatgcactgggtccgccaggcgccgaggggaagggctggagtgggtctcgacgtnttcatcgtgatgggaccaccacaacttacggcgacctccgtgaaggccgattcacntctcagnacatccgacccaaacgactacccctntaacttgaacaaatcgaaacagttcttaagagtacgacggacncgggtctagtctatttactggtagcgagttgggacgggtctaaccgtanaaacgttcgggctaaaggttattattacttagtttaaggaagttggacgttcggnggggacccncggggacctacgg

SEQ ID NO: 313993 - DNA, 555 bp, Homo sapiens
  misc_feature: GZ8MTXP02FWSM5.25.82.H05.1.454.CMB.2.raw
  modified_base (288)..(288): a, c, t, g, unknown or other
  misc_feature (288)..(288): n is a, c, g, or t
  modified_base (291)..(292): a, c, t, g, unknown or other
  misc_feature (291)..(292): n is a, c, g, or t
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccagtggggtgttgtgctgactcagtcgccaccgtccctggcccgtcacccctggagagccggcctccatcctcctgcaggtctagtcagaacctcatgcatagtaatggatacagctatttggattggacctgcagagccaggcagtcncannctcnatctagttgcttctcnccgtcccgggcccccggtcngactaggttcngtgcgtagtgatcgagccactacttattttcactagagcactacacgacgagagtaggaggtgtagaggtagttagggtttagggtttagttagtagtacgtagtgacgacgtacctacctaactaaacctaccgtaccgtaccgtacctaccgttaccggtaccggaacggaacgaacgacgtacgtaacggtaaacgttaaaacgtaacg

SEQ ID NO: 313994 - DNA, 573 bp, Homo sapiens
  misc_feature: GZ8MTXP02FQVZI.25.82.H05.1.454.CMB.2.raw
  modified_base (267)..(267): a, c, t, g, unknown or other
  misc_feature (267)..(267): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (458)..(458): a, c, t, g, unknown or other
  misc_feature (458)..(458): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggaggtccggggaaccttagttcgacccggggggtcctgagactctcctgtgtgggatctggagtcgccgtgactaaatnttggatgcactgggtccgccgaggcgccgaggggaaggggctggagtggtctcagtattcatcgtgagtgggaccaccacaactacgcggacctcgtgaggccatcacntcncanagcancgaccaacgacaccctctacttgacaaatcgaaactagtcttagagtacgaggacacggctgtctattacnggtgacgtatgggcgggtactacgtataacgtcgggatagtttaattacttaagtttaagtttaacggaagtacgggtacgtcggtcgggggtacccgacggggacctaaccggg

SEQ ID NO: 313995 - DNA, 634 bp, Homo sapiens
  misc_feature: GZ8MTXP02JN7L6.25.82.H05.1.454.CMB.2.raw
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtggggtgttgtgctgactcagtcgccaccgtccctggccgtcacccctggagagccggcctccatctcctgcaggtctagtcagaacctcatgcatagtaatggatacagcttagttggattggtacctgcagaggccgaggcagtcnccacngctcctgactcttagtttcgcttctcacccgtccccgggggtcccccgggtcctacggacgtacggttcacggggtgcgtaggtgggactcgaagggcctaactactttacgttttacacgttagacgtactacgtacgaacgcgaagtagggttaggggacggtacgttagggtaaggttaggtttaggggtttaggggttttaattacgttacgtacgtagttcggacgtacgtacccttaacgtaacctaaaccgtccgtaccgtactaccgtacccgttacggaccgtaaaggaccgaacggtacgtacggtaaacgtaaacgtaaacgtaacgg

SEQ ID NO: 313996 - DNA, 597 bp, Homo sapiens
  misc_feature: GZ8MTXP02HN72T.25.82.H05.1.454.CMB.2.raw
  modified_base (250)..(250): a, c, t, g, unknown or other
  misc_feature (250)..(250): n is a, c, g, or t
  modified_base (284)..(284): a, c, t, g, unknown or other
  misc_feature (284)..(284): n is a, c, g, or t
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagcttgggttttccttgtcgcctattttaaaaggtgtccagtgtgatgtgcaacgtggtggagtccggggaaccttagttcgacccgggggtcctgagactctcctgtgtggatctggntcgcgtgactaaatagttgatgcacgtgggtccnccgaggcgccgaggggaagggctggagtgggtctcgacgtatcatcggtgagtcgggacccaccaactaactcggcgacctccgtagacgggccattccacgntctccaagagacanccgaccaaacgaccaccctactacttacgaactaaaattcgaaactacgtacgttagaacgttacgaacgggacacgggtcttagtacttagtactgtgcgagtgggcggacttaacgtacgtaacgtcggacttaggttaattattaagtttattaacggaatcggtacgtcgacggggtccgacgggactacgg

SEQ ID NO: 313997 - DNA, 556 bp, Homo sapiens
  misc_feature: GZ8MTXP02HVXHE.25.82.H05.1.454.CMB.2.raw
  modified_base (318)..(318): a, c, t, g, unknown or other
  misc_feature (318)..(318): n is a, c, g, or t
  modified_base (380)..(380): a, c, t, g, unknown or other
  misc_feature (380)..(380): n is a, c, g, or t
  modified_base (438)..(438): a, c, t, g, unknown or other
  misc_feature (438)..(438): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccggggaaccttagttcacccggggggtccctgagactctcctgtgtgggatctggagtcgccgtgactaaatattggatgcactgggtccgccaggcgccaggggaaggggctggagtgggtctnacgtatcatcgtgatgggaccaccacaacttacgcggacctccgtgaagggccgattcaccntcctccagagacatcgcccaaacgacacccctctacttgcaaaatgaacagtcttagngtcgaggacaggtctgtctatactgtagcgatgggcggctaactataactggggctaggttattagtatttagttacggaaatcgggaacttcgtgggggcccgcggggacctacggg

SEQ ID NO: 313998 - DNA, 506 bp, Homo sapiens
  misc_feature: GZ8MTXP02HGGUJ.25.82.H05.1.454.CMB.2.raw
  modified_base (231)..(231): a, c, t, g, unknown or other
  misc_feature (231)..(231): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccagtggggtgttgtgctgactcagtcgccaccgtccctggccgtcacccctggagagccggcctccatctcctgcaggtctagtcagaacctnatgcatagtaatggatacagctatttggattggtacctgcagaggccagggcagtctccacagctcctgatctatttggcttctcacgtccggggcccccggggtctgacaggttcaggtgcagtggatcgaggcacactatttttcactgagcatcagcagagtggaggctgaggagtggtttggggtttatacgtgcatgcagcctactacaaactcctccgactccgaccttcggaccaagggacacggtacaggacgaacttaaacgaacg

SEQ ID NO: 313999 - DNA, 565 bp, Homo sapiens
  misc_feature: GZ8MTXP02FK6ET.25.82.H05.1.454.CMB.2.raw
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
  modified_base (353)..(353): a, c, t, g, unknown or other
  misc_feature (353)..(353): n is a, c, g, or t
  modified_base (411)..(411): a, c, t, g, unknown or other
  misc_feature (411)..(411): n is a, c, g, or t
tcagactgtacagtcacgaccggtgctcgatttagtcgagctctctcgcggggctgatcaggactcctcagttcaccttctcacaatgaggctccctgctcaccgctcctggggctgctaatgctctgggtctctggaaccaggtgggggtgttgtgctgactcagtccgccaccgtccctggccgtcacccctggagagccggcctcatctcctgcaggtctagtcagaacctcatgacaatagtaaatggatacagtctaatttggatttggacctgcagaggccaggcagtcncangctcngatcttattgcttcncaccgtcccggggcccccggtctgactaggttcngtgcagtgatcgagcacacttattttcactgagcaatcagcgaggaggtagggacggngtagggtaggtagttgggtttaggggtttattacgtgtctagtggactacgtacccttactaaacctaaacctcccgtacctactaccgtaacccgttccggaaccgaaacggaccgaacgtacgtaggaaacgtaaacgttaaacggtaacgg

SEQ ID NO: 314000 - DNA, 547 bp, Homo sapiens
  misc_feature: GZ8MTXP02I1QS4.25.82.H05.1.454.CMB.2.raw
  modified_base (350)..(350): a, c, t, g, unknown or other
  misc_feature (350)..(350): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcaccctggagagccggcctccatcctcctgcaggtctagtcagaacctcatgcatagtaatggatacagctattggattggtacctgcagaggccagggcagtctccacagctcctgattctatttgcttctcacgtccggggcccccgggtcctgaccaggttcngtgcaggtgatcgaggcacactattttcactgagcatcagcagaggtaggaggtcgtaggtaggtagttgggtttaggggtttattacgtgctagttcgacgtagccctactaacaaaccttccgtacctactccgtaacccgttcggacccgaaagggacaacggtacgtacggaagtaacgttaaaacgtaacgg

SEQ ID NO: 314001 - DNA, 695 bp, Homo sapiens
  misc_feature: GZ8MTXP02HD5E7.25.82.H05.1.454.CMB.2.raw
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgcctattttaaaaggtgtccagtgtgatgtgcaacgtggtggaggtccggggaaccttaggttcgacccggggggtcctgagactctcctgtgtgggatcgtggagtcgccgtgactaaatattggatgcacgtcgggtccgccgaggccgccgaggggaaggggcgtgggaggtgggtctcgtacgttatcagtcgtgagtcgggaccacccaacgtaaccgtacggccggtacccctccggtaggaacgggtaccgtacttaccgacctactcctaccgaagtacgacactccgacccaaacgacctaacccccttactaacttacggaaccctaaaagttcgaaaaccgtagtttaccttaaagggacgttaccggaaacggaccgtaccgggtcttaggttcctttaaagttaccgtggtacgacggtaagtcggggtacgactttaaccgtaagtaccgtcgggtctaagtttaattacttagtttaacgtttaacggaagtcgggacgttcgggtacggggccgtacggggaccctaggg

SEQ ID NO: 314002 - DNA, 708 bp, Homo sapiens
  misc_feature: GZ8MTXP02HBYY9.25.82.H05.1.454.CMB.2.raw
  modified_base (267)..(267): a, c, t, g, unknown or other
  misc_feature (267)..(267): n is a, c, g, or t
  modified_base (318)..(318): a, c, t, g, unknown or other
  misc_feature (318)..(318): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccggggaaccttaggttaacccggggggtccctgagactctcctgtgtgggatctggagtcgccgtgactaaatnttggatgcacgtggtccgccaggcgccgaggggaagggctggagtgggtcnctacggtattcgatcgtagagtcgggaccaacacctaaacgtttaccggcggtactcccccggtagaaacggggccattccgaacccatcctaccgagacgaacagtacgacccaaaccgaccctaccccttacttaaaccgttaacaaacgtaagtaaacgtacgtacgtttaacgaacgtacggaacgacggacgtacccggttgttacgttaactttaaccggtgtcgtaccggaagttcgggacggggtacccttaattaagtaacccggtaccgggtacggttaacgtttaaacgtttaattaaacgttttagtttaacccggaagtttacggaacgttcggtacgggggtcccgggaccggaccggtaacccggtggttaaccg

SEQ ID NO: 314003 - DNA, 573 bp, Homo sapiens
  misc_feature: GZ8MTXP02I6QYV.25.82.H05.1.454.CMB.2.raw
  modified_base (267)..(267): a, c, t, g, unknown or other
  misc_feature (267)..(267): n is a, c, g, or t
  modified_base (377)..(377): a, c, t, g, unknown or other
  misc_feature (377)..(377): n is a, c, g, or t
  modified_base (408)..(408): a, c, t, g, unknown or other
  misc_feature (408)..(408): n is a, c, g, or t
  modified_base (430)..(430): a, c, t, g, unknown or other
  misc_feature (430)..(430): n is a, c, g, or t
  modified_base (467)..(467): a, c, t, g, unknown or other
  misc_feature (467)..(467): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgcctattttaaaaggtgtccagtgtgatgtgcaactggtggagtccggggaaccttagttcgacccggggggtcctgagactctcctgtgtgggatctggagtcgccgtgactaaatnttggatgcgctgggtccgccaggcgccgaggggaagggctggaggtggtctcacgtattcatcgtgagtcggaccaccacaactacgcgacctcgtgaaggccatcaccntctcagagacatccgaccaaacgcacccctntaacttgactaaaatcgaaacngtcttaggagtacgaggacacggtctagtctaattcngtgtcgagtgggacggctaacgtagtaacgtcgggactaagttattataacgtttaagttacggaaattgggaaccgttcggacggggccgacggggacctacggg

SEQ ID NO: 314004 - DNA, 512 bp, Homo sapiens
  misc_feature: GZ8MTXP02FGS8H.25.82.H05.1.454.CMB.2.raw
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (405)..(405): a, c, t, g, unknown or other
  misc_feature (405)..(405): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccagtgggggtgttgtgctgactcagtcgccaccgtccctggccgtcaccctggagagccggcctcatctcctgcaggtctagtcagaacctcatgcatagaatggatacagctattggattggacctgcagaggccagggcagtctccacagctcctgatctatttggcttctcacgtccggggccccccggggtacncggacnggttcngtggcagtgatcaggcacactattttcactgagcatcagcagagtgggagctgaggnttgggtttgggtttattagtgcatgcacgtcctactactaaacctcctaccgactactacccttcgggaccaacggggacacgacgtggaataacgttaaccgaacg

SEQ ID NO: 314005 - DNA, 629 bp, Homo sapiens
  misc_feature: GZ8MTXP02GDRCV.25.82.H05.1.454.CMB.2.raw
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggcccgtcaccccgtggagagcccggcctccatctcctgcaggtctagtcagaacctcatgcatagtaatggatacagtcttagtttggatttggtacctgcgaggaggccgagggcagtcctccacagtcctcctgacttcgttagtttcggcctttcgtcgaccccggttcccccgggggcccccccggggttacctggaactacggggtttaccagggttcgggctaaggttgggaattccgagggacctaacctacttactttttacacgttaggacacatacgagcaggtaggtaggggacggtgtagggaggttagtttagggtttacggggtttattacgtgcgtaagtgactacgtcctactaaaccaaaccttccctacgtactccgtaccgttccgaccgaaacggaccgacgtacgtaggtaagtaacgtaaacgtaacg

SEQ ID NO: 314006 - DNA, 578 bp, Homo sapiens
  misc_feature: GZ8MTXP02G8H4O.25.82.H05.1.454.CMB.2.raw
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
  modified_base (427)..(427): a, c, t, g, unknown or other
  misc_feature (427)..(427): n is a, c, g, or t
  modified_base (465)..(465): a, c, t, g, unknown or other
  misc_feature (465)..(465): n is a, c, g, or t
  modified_base (575)..(575): a, c, t, g, unknown or other
  misc_feature (575)..(575): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgcctattttaaaaggtgtccagtgtgatgtgcaacgtggtggaggtccggggaaccttaggttccggacccggggggtcctgagacctctccgtgtgtgggatcgtggagtcgccgtgaactaaatnttggatgcacgtgggtccncaggccgccgaggggagggctggagtgggtctcgacgtattcagtcgtgagtcggaccacacactcgcgacctcgagaggccatcacntcncagagacanccgacaacgcaccctnactgacaaatgaaacngtactagacgtacgaggacacggtctggtactatacgngtgcgagttcggcggtactaacgtagtaccgtgggacttaagttacttattagttagttaacggaaagttcgggaccgtacggtcgggggacccgtccggggtaaacccncgg

SEQ ID NO: 314007 - DNA, 620 bp, Homo sapiens
  misc_feature: GZ8MTXP02IIBX7.25.82.H05.1.454.CMB.2.raw
  modified_base (268)..(268): a, c, t, g, unknown or other
  misc_feature (268)..(268): n is a, c, g, or t
tcagactgtacagtcacgaccggtgctcgatttagtcgagctctctcgcggggcccagccctgggacacccagctgtttccgcttgctgatcaggactgcacacagagaacgcaccatggacttcgggctgagcttgggttttccttgtcgcctattttaaaaggtgtccagtgtgatgtgcaacgtggtggaggtccggggaaccttaggttcgacccgggggtcctgagactctctgtgtggatcgtggagtcgcgtgactaaatnttggatgcacgtggccgccaggcgccgaggggaagggctggagtggtctcgacgtatcatcgtgagtcggaccaccaacacgttacgcgaccctccgtagaacgggccgtattccgaacctgtcctaccagagaccatccgacccaaacgaccaccccttatacttagaccaaaagttcgaaacctagttaccttaggaacgtcggaacgtacacgggtctaggttacctattactggtacgcgtagtcgggcggtactaaccgttagtaaaccgtgggacttaggttaatttacgtattttagttacggaagttcggacgttcggacggggtcccgacgggtacctaccgg

SEQ ID NO: 314008 - DNA, 825 bp, Homo sapiens
  misc_feature: GZ8MTXP02GR06F.25.82.H05.1.454.CMB.2.raw
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcaccctggagacgccggcctccatctcctgacaagtctagtcaaacgcctcgtactacattcgacggaaacacctactgcattggtccagctgacggccaggccaatctaccgaacggcgtaccttaaaatttaaacgttaaacggttttaccgtaaaacccggggtaccggttaccgggggggttacccccaaaggtaccaacggtaatttaccccggaacgggtccgggaccgtaaggtcggaccggttaccgagggggacctaaccgttaggtaaccttttaccaaacgtaaaccgtttaagaaaaacttccggaaacggttccgggaaacggggggtttagggaacggggtacggttaaggggtaaggggttaacggttttacgggggttttacgggggtttttaaatttacccggtttaggggacctaagggtttacggaaccggttaaggggacccttaaacccgaccgttaaccggttcgggttacccgtttttcccgggtacggttttcccgggggaccccgtttaagggggaaccggtaagggtaacgggtagggttaacttaaacgggtaccaaacggtttacgaaacggtttggtaacggttcgacgtacccgtaaaccttagtttcccg

SEQ ID NO: 314009 - DNA, 538 bp, Homo sapiens
  misc_feature: GZ8MTXP02G18YT.25.82.H05.1.454.CMB.2.raw
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (353)..(353): a, c, t, g, unknown or other
  misc_feature (353)..(353): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtgttgtgttgactcagtcgccaccgtccctggccgtcacccctggagagccggcctccatctcctgcaggtctagtcagaacctcatgcatagtaatggatacagctattggattggtacctgcagagccagggcagtctccanagctctgattctatttgcttcncncgtccccggggcccccggtctgactggttcagtggnaggtgatcgaggcacactattttcgactgagcatcagcagagtggaggctaggaggtagttgggtttaggggtttatacgtgcagtggacacgtcctactaacaaacctccgtacctacgtcctacccgttcggaccgaaacgggaacacggaacgtacgggaactaaacgtaaaccgaactggg

SEQ ID NO: 314010 - DNA, 589 bp, Homo sapiens
  misc_feature: GZ8MTXP02FJ5Z0.25.82.H05.1.454.CMB.2.raw
  modified_base (375)..(375): a, c, t, g, unknown or other
  misc_feature (375)..(375): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggccgtcaccctggagacgccggcctccatctcctgcaggtctagtcagaacctcatgcatagtaatggatacagtcttaatttggattggacctgcaggaggccgagggcagtcctccacagtcctcctgactcttatttcggctttctcgacccgtccccgggggccccccggggtcctaggacgtacggtttcnggtcggacaggttgggatcgacggcactacttactttttcacttgacgcatcagcgagagtgggaggctggaggtagttagggtttagggtttattacgtgctagtgacacgtcctaacctaacctaaaccttccctaccgtactacccgtaacccgttccggaaccgaaacgggacaaccggacgtacggaaacgtaaacgtaaacggtaacg

SEQ ID NO: 314011 - DNA, 638 bp, Homo sapiens
  misc_feature: GZ8MTXP02I2ZQV.25.82.H05.1.454.CMB.2.raw
  modified_base (272)..(272): a, c, t, g, unknown or other
  misc_feature (272)..(272): n is a, c, g, or t
  modified_base (406)..(406): a, c, t, g, unknown or other
  misc_feature (406)..(406): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagcttgggttttccttgtcgcctattttaaaaggtgtccagtgtgatgtgcaactggtggaggtccggggaaccttaggttccgacccggggggtcctgagactctcctgtgtgggatcgtggagtcgccgtgactaaatnttggatgcacgtgggtccgccagggcgaccgaggggaagggctggaggtggtctcacgtattcatcggtgagtcgggaccaccaactaaccgttacgcggtaccctccggtaggaacgggccgtattccacctntcctaccgaagacgacactccgacccaaacgacctacccctactacgttacgacctaaaagtcgaaactagttaccttaggacgttaccggaaaggaccgacgggtcttagtacgttattacgtggtacgcgtagtcgggacggtacttactacgtaacgtcgggactagtttattactaatttagtttaacggaagttcggacgttcggcggggcccgacgggtactacgg

SEQ ID NO: 314012 - DNA, 565 bp, Homo sapiens
  misc_feature: GZ8MTXP02GEOEW.25.82.H05.1.454.CMB.2.raw
  modified_base (385)..(385): a, c, t, g, unknown or other
  misc_feature (385)..(385): n is a, c, g, or t
  modified_base (447)..(447): a, c, t, g, unknown or other
  misc_feature (447)..(447): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccggggaaccttaggttccgacccggggggtccctgagactctcctgtgtgggatctggagtcgccgtgactaaatattggatgcacgtgggtccgcaggcgccgagggaaggggctggagtggtctcacgtattcatcgtgatgggaccaccacaacttacgcggacctccgtgaagggccgattccacctntcctaccagacgacatccgaccaaacgacaccctctacttgacaaatcgaaacagtcttagngtacggagacaggctgtactatactgngcgtagngggcggactaacgtactacgtcggctaagttattattattaagtttacggaagttggaacgtcggtggggccgcgggacctcgg

SEQ ID NO: 314013 - DNA, 577 bp, Homo sapiens
  misc_feature: GZ8MTXP02JL7P8.25.82.H05.1.454.CMB.2.raw
  modified_base (380)..(380): a, c, t, g, unknown or other
  misc_feature (380)..(380): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccggggaaccttagttcgacccgggggtcctgagactctcctgtgtgggatctggagtcgccgtgactaaatattggatgcactgggtccgccaggccgccgaggggaaggggctggaggtgggtctcgacgtattcatcgtgatgggaccaccacaacttacgcgacctccgtgaaggccgatcacntctccagagacatcgacccaaacgacacccctctacttgacaaatcgaacagtctagagtcgagacacggctgtctattactgtagcgtagtgggcgggacttacgtataaccgtcggggactaggtttattaacttagtttaagtttaacggaagttcggaacgttccggtgggggcccacgggggaccctacggg

SEQ ID NO: 314014 - DNA, 592 bp, Homo sapiens
  misc_feature: GZ8MTXP02IG49Q.25.82.H05.1.454.CMB.2.raw
  modified_base (268)..(268): a, c, t, g, unknown or other
  misc_feature (268)..(268): n is a, c, g, or t
  modified_base (388)..(388): a, c, t, g, unknown or other
  misc_feature (388)..(388): n is a, c, g, or t
  modified_base (420)..(420): a, c, t, g, unknown or other
  misc_feature (420)..(420): n is a, c, g, or t
  modified_base (464)..(464): a, c, t, g, unknown or other
  misc_feature (464)..(464): n is a, c, g, or t
  modified_base (481)..(481): a, c, t, g, unknown or other
  misc_feature (481)..(481): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccgggggaaccttaggttcgacccggggggtcctgagactctcctgtgtgggatctggagtcgccgtgactaaatnttggatgcactgggtccgccaggcgccgaggggaaggggctgggagtgggtctcgacgtattcatcgtgagtcgggaccaccacaacttacgcggacctccgtgaacggccattccaccntcctccagagacatcgacccaaacgcaccctntacttgacaaatgaaactgtactagacgtcgaaggacacgggtnttagtcttaattaccgngtacgcgtagtgggacggtctaacgtaataacgtcgggactaagtttattataagtttagttaacggaagttcggacgttcggtacgggggcccgacggggacccgtacgg

SEQ ID NO: 314015 - DNA, 660 bp, Homo sapiens
  misc_feature: GZ8MTXP02FL13B.25.82.H05.1.454.CMB.2.raw
  modified_base (235)..(235): a, c, t, g, unknown or other
  misc_feature (235)..(235): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtcgccaccgtccctggcccgtcacccctggagacgccggcctccatctcctgcaggtctagtcagaacctnatgacatagtaatggatacagcttagtttggatttcggtacctgcaggacggccgagggcagtcctccacagcctcctgacttcttagtttcgctttcctaccgaccggtcccccgggggcccccccggggtcctacggaccgtagggtttcacgggtggacgtaggtacggactcggaggaccctactactttacgtttttccacgttaggacgactacgtacgaacgtccgaaaggtagggttaggggacggacggttagggaggggttagtttagggggttttaggggtttaccttaagtggtactagtcgaccgtacgtacccttactaaaccctaaacctcccgtaccgtacttacccgtaccgttaccggaaccgaacgggtacacggtacgtaggtaacgtaaacgttaaccgtaacg

SEQ ID NO: 314016 - DNA, 747 bp, Homo sapiens
  misc_feature: GZ8MTXP02G5G01.25.82.H05.1.454.CMB.2.raw
  modified_base (150)..(150): a, c, t, g, unknown or other
  misc_feature (150)..(150): n is a, c, g, or t
  modified_base (235)..(235): a, c, t, g, unknown or other
  misc_feature (235)..(235): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtnttgtgctgactcagtcgccaccgtccctggcccgtcacccctggagacgccggcctccatcctcctgcaggtctagtcagacctnatgcatagtaatgatacagtcttagttggattggacctgcagacggccagggcagtcctccacgagcctctgtacttcgttatttcggcttcgtacacccgggttcccggggcccccgggttctagaccgttagggttcaggggtcggacgtaggtggacgtacgacgaccctaacgtactttaacgtttttacaaccgttaggaacgtactaaacgtcgaaacgggaccgagggttacgtacgggggacgggttacggttaagggtacgggggttaaggttttacgggggtttttaagggggttttaaaccctttcggttagtaccgtaagttccggtacgtaccggttacccttaaccgtaaacccttaaaacccgttcccgttacccgtaaacgttacccccgttaaacccggttaccggggtaacccgtaaaacgggggtacccgaaaccgggttaaccgtaaaggggtaaaaccggttaaaacggttttaaaaacggtaaacccggg

SEQ ID NO: 314017 - DNA, 528 bp, Homo sapiens
  misc_feature: GZ8MTXP02GRF00.25.82.H05.1.454.CMB.2.raw
  modified_base (342)..(342): a, c, t, g, unknown or other
  misc_feature (342)..(342): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccagtggggtgttgtgctgactcagtcgccaccgtccctggccgtcacccctggagagccggcctccatctcctgcaggtctagtcagaacctcatgcatagtaatggatacagctattggattggtacctgcagagccagggcagtctcacagctcctgattctatttgcttctcagtccgggcccccgggtctgacaggttcngtgcagtggatcaggccacactattttcactgaagcagtcagcagagtaggaggcgtgaggtattggtttaggggttattacgtgctatggacagtcctactacaaactcctccgactaccgaccttacggaccctaaaggggacccaacggaccgttaggaacgtaacgtttaaaacgtaaaccg

SEQ ID NO: 314018 - DNA, 610 bp, Homo sapiens
  misc_feature: GZ8MTXP02IV3II.25.82.H05.1.454.CMB.2.raw
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (333)..(333): a, c, t, g, unknown or other
  misc_feature (333)..(333): n is a, c, g, or t
  modified_base (398)..(398): a, c, t, g, unknown or other
  misc_feature (398)..(398): n is a, c, g, or t
  modified_base (438)..(438): a, c, t, g, unknown or other
  misc_feature (438)..(438): n is a, c, g, or t
  modified_base (451)..(451): a, c, t, g, unknown or other
  misc_feature (451)..(451): n is a, c, g, or t
  modified_base (494)..(494): a, c, t, g, unknown or other
  misc_feature (494)..(494): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaacgtggtggaggtccggggaaccttaggtccgacccgggggtcctgagactctctgtgtggatcgtggngtcgcgtgaactaaatnttggatcggcacgtcgggtccgccgaggccgaccggaggggaaggggctggaggtggtctcagttntcagtcgtgacgtcggaccaccaacgtacgttacgcgaccgtccggagaacggtccattccaccngtcccacgagtagaccatcccgacccaaacgcctaccctntactagactaaangaactagtctagagtaccgagacgcggctagtacttaattcgngtcgacgattccggaacggtctaacgtaatacgtcgggtacttagttaagttaacttagttaacgtttaacggaagttcgggtacgtcgggtacggggcccggacggtaccgacgg

SEQ ID NO: 314019 - DNA, 623 bp, Homo sapiens
  misc_feature: GZ8MTXP02GBXD8.25.82.H05.1.454.CMB.2.raw
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtggggtgttgtgctgactcagtcgccaccgtcccgtggccgtccaccccgtggagacgccggcctccatctcctgcaggtctagtcagacctcatgcatagtaatggatacagtctattggattggtacctgcgagacggcaggcacgtctccacagtcctcctgtatcttagtttcggcttccgtcaccggtccccggggcccccccgggttcctacggtaccgtacggttctagggtcgggactagggtcggactacggacggtcctaactacttacgtttttaccgacttggactacactacgagacgagtaggagggtagcgtagggtagtagttgggtttagggttacttacgtgtacgtagtgtacgtacgtacctacctaaacctaaaccttcccgtaccgtactacccgtaccgttcccggaaccgtaacgggaacctacggtacgtaggtaaacgtaacgtaaacgtaacgg

SEQ ID NO: 314020 - DNA, 634 bp, Homo sapiens
  misc_feature: GZ8MTXP02FR04G.25.82.H05.1.454.CMB.2.raw
  modified_base (456)..(456): a, c, t, g, unknown or other
  misc_feature (456)..(456): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtgttgtgctgactcagtccgccaccgtccctggcccgtcaccccgtggagacgcccggcctccatcctcctgcaggtctagtcaagaacctcatgacattaagtaatggatacagtcttagtttggattgtacctgacgaggaggccgtagggcacgtcctaccgacacgtcctccgagtattccttattcggccttcgtccgacccggtccccggggtcccccccggtctcggtaaccgtaggttcgaggtggactaagggtcgatcgacgtactaactacgtttactttcgaacgttgacgctaanagacgacgagtaggtaggaggtagtaggtaggtaggtttagggtttaggtttacgttacgtagtacgtacgtcgtacgtacgtacctaacctaaccgtaaccgtaccgtacctaccgtaccgtaccgtaccgaaccgaacgaacgaacgtacggtacgtaacgtaacgtaaacgtacg

SEQ ID NO: 314021 - DNA, 686 bp, Homo sapiens
  misc_feature: GZ8MTXP02FUF03.25.82.H05.1.454.CMB.2.raw
  modified_base (252)..(252): a, c, t, g, unknown or other
  misc_feature (252)..(252): n is a, c, g, or t
  modified_base (322)..(322): a, c, t, g, unknown or other
  misc_feature (322)..(322): n is a, c, g, or t
  modified_base (435)..(435): a, c, t, g, unknown or other
  misc_feature (435)..(435): n is a, c, g, or t
tcagactgtacagtcacgaccggtgctcgatttagtcgagctctctcgcggggctgatcaggactcctcagttcaccttctcacaatgaggctccctgctcagctcccggggctgctaatgctctgggtctctggaaccaggtggggtgttgtgctgactcagtccgccaccgtccctggccgtcaccctggagacgccggcctccatctcctgcaggtctagtcagaacctcatgcatagtaatggatacngcttattggattggacctgcaaggcggctagggctagtcctccacagctcctgacttctatttggccttntccgtacggtcccccccggggtccccccggggttccaggtacccgtggttcgaagggttcggacgtaggtggacttgacggactaactactactttttacgacttagacgtanacgtacagacgtaagaggtgggtaggacgttagggtaggttagtttacgggttttagggggttttaacgttaacgttcgtaacgtacgtacgtaccgaacgtaccctaaacccgttaaaaccgtaaaacccgttcccgtacccgtaaccgttacccgtaacccgtttaccggggaacccgtaaaacgggggaaccaaaccgggtaacgtacgggaaacgtaaaaccggttaaaaccggaacggtttaacgg

SEQ ID NO: 314022 - DNA, 684 bp, Homo sapiens
  misc_feature: GZ8MTXP02H0UHS.25.82.H05.1.454.CMB.2.raw
  modified_base (151)..(151): a, c, t, g, unknown or other
  misc_feature (151)..(151): n is a, c, g, or t
  modified_base (258)..(258): a, c, t, g, unknown or other
  misc_feature (258)..(258): n is a, c, g, or t
  modified_base (402)..(402): a, c, t, g, unknown or other
  misc_feature (402)..(402): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtnttgtgctgactcagtcgccaccgtcctggccgtcaccctggagacgccggcctccatcctcctgcaggtctagtcacgaacctcatgcatagtaatggaatacagtnttacgttggacttggtaacctgtacaggacggcgagggtctaacgtcctaccaactcggccttcctagtactttacgttagtttcggtaccttcgtacgcccggttcccccgggggcccccggttccacgtacgtcggttacgngggttcgggccgtagggttcgacgttacgacgggtacctaacgtacttacgtttttacacgttacgaacgtctaacgtaccgaggtacgaaaggtacgggtagggtacggtcgtagggtaggtacggtttaggggtttacgggtttacgttaacgtcggtctaagtcgtacgtacgtaccttaaccgtaacctaccttccgtaccgtaaacgtcccgtaaccgttaccggaaccgaacggtaccgtaacggtaccgtaggtaacgtaaagtaaacgtaacgg

SEQ ID NO: 314023 - DNA, 846 bp, Homo sapiens
  misc_feature: GZ8MTXP02JHLJN.25.82.H05.1.454.CMB.2.raw
  modified_base (319)..(319): a, c, t, g, unknown or other
  misc_feature (319)..(319): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgcctattttaaaaggtgtccagtgtgatgtgcaactggtggacggtccggggaaccttaggttaacccgggggtcctgagactctcctgtgtgggatcgtggagtccgcgtgaactaatagtgatgcacgtcggccgcgaggcgcgaggggagggcgtggaggtgggtcncgtacgttattctagtcggtagtaggtaccgggaacccaccgaacgtaaaccgttacgggaccggtaccgttacccgggtacggtaaccggggcccgtacttacccaaccacgttccctacgaaacgaccgaacctaacgtaccccgaccccgtaaaccctaaccctacccccgttaaactttaacccgttaacgaaaccttaaaagtacggtaaaaccgtaagtttaacccggttaaacgggtacgggttaaccggaaacgggtaacccggtacggttaccgtttacgggttaacctttaacggtttaccttaggggtaccgtaacggggtaaggttcgggggaacccccggttaatttaaccgtaaaccggttttaaaaccggtccggggttaaactttaaacggttttaaaattttaagttttaaacgttttaaaacgggtttaacgggaaacggtttcggggtaaaccggtttcggggcccggggggttaacccgaccgggtacccggttaacgggtttaacc

SEQ ID NO: 314024 - DNA, 676 bp, Homo sapiens
  misc_feature: GZ8MTXP02FH7CH.25.82.H05.1.454.CMB.2.raw
  modified_base (151)..(151): a, c, t, g, unknown or other
  misc_feature (151)..(151): n is a, c, g, or t
tcagactgtacagtcacgaccggtgctcgatttagtcgagctctctcgcggggactgatcaggactcctcagttcaccttctcacaatgaggctccctgctcagctcctggggctgctaatgctctgggtctctggaaccaggtgggggtnttgtgctgactcagtccgccaccgtccctggcccgtcaccccgtggagacgcccggcctccatcctcctgcaggtctagtcaagaacctcatgcatagtaatggatacagtcttagttggattcggtacctgacaggacggccgagggcaacgttcctaccaacgacgtccctccgtagtaacttcgttttaatttcggcctttcctaccgtaccccgggtccccccgggggtaccccccgggtctggtaaacccgtcgggttcaggggtcgggacgtaggtcggtactacggacggtctaaacctactttaactttttacgacgtgtaacgctaatcgaacggacgaagggtaggtacgggtaggtacgtagggggtaaggttaaggttttggggttttaaggggttttacttacgtagtaccgtaggttcacgtacgtaccctaacgtacctaaaccgtcctacgtactaccgtaccgtcggaaccgaacggactacgacgtagaaactaacgtaacgtacgg

SEQ ID NO: 314025 - DNA, 657 bp, Homo sapiens
  misc_feature: GZ8MTXP02IRTKO.25.82.H05.1.454.CMB.2.raw
  modified_base (150)..(150): a, c, t, g, unknown or other
  misc_feature (150)..(150): n is a, c, g, or t
  modified_base (232)..(232): a, c, t, g, unknown or other
  misc_feature (232)..(232): n is a, c, g, or t
tcagactgtacagtcacgaccggtgctcgatttagtcgagctctctcgcggggctgatcaggactcctcagttcaccttctcacaatgaggctccctgctcagctcctggggctgctaatgctctgggtctctggaaccaggtgggggtnttgtgctgactcagtcgccaccgtccctggccgtcacccctggagagccggcctccatctcctgcaggtctagtcagacctnatgcatagtaatggatacagcttagttggatttcggtacctgcaggacggccagggcagtcctcaacagtcctccagactcttatttcggccttctcgaccgttccccggggcccccgggtcctacggaccgtagggtttccgagggttcggactaacggtcggtaactccgaagggtaccaccgtaaactactttttacgacttagacgctagtacgtagacgagtacggtagggaaggtcgtacgggtaaggtacggtttacgggtttagggggttttacgtttaccgttggtacgtacgttcggacgtaaaccgtcccttaacctaaacccgtaaaccttaccgtaacccgtactaccgtaacccgtaccggaaccgaaacggacgaacgtacggacgtaaacgaaacgtttaaaccgaacg

SEQ ID NO: 314026 - DNA, 623 bp, Homo sapiens
  misc_feature: GZ8MTXP02JAG89.25.82.H05.1.454.CMB.2.raw
  modified_base (268)..(268): a, c, t, g, unknown or other
  misc_feature (268)..(268): n is a, c, g, or t
  modified_base (322)..(322): a, c, t, g, unknown or other
  misc_feature (322)..(322): n is a, c, g, or t
tcagactgtacagtcacgaccggtgctcgatttagtcgagctctctcgcggggcccagcccctgggacaccccagctgtttccgcttgctgatcaggactgcacacagagaacgcaccatggagttcgggctgagctgggttttccttgtcgccattttaaaaggtgtccagtgtgatttgcaactggtggagtccgggggaacttagttcgacccggggggtcctgagactctcctgtgtgggatctggagtcgccgtgactaaatnttggatgcacgtgggtccgccgaggcgccgaggggaagggctggaggtgggtcncacgtattcatcgtgagtcgggaccaccacaacgttacgcggactcccggtgaacggcgattcaccatctccagagacatcgccaaacgaccaccctactacttacgactaaaatgaaactgttacttaagacgtacgaggacacgggcttgtaccttattacgtgtggacgtagtcggggcggtacttaacgtaattaaaccgtcggggtaaccttaagtttaatttaaacttacgttttaaacgtttaggttaaagtcggtaacgttcggtacggggccgtaccgggaccgtacgtacg

SEQ ID NO: 314027 - DNA, 715 bp, Homo sapiens
  misc_feature: GZ8MTXP02JZEW8.25.82.H05.1.454.CMB.2.raw
  modified_base (263)..(263): a, c, t, g, unknown or other
  misc_feature (263)..(263): n is a, c, g, or t
tcagactgtacagtcacgaccggtgctcgatttagtcgagctctctcgcggggcccagccctgggacacccagctgtttccgcttgctgatcaggactgcacacagagaacgcaccatggagttcgggctgagctgggttttccttgtcgccattttaaaaggtgtccagtgtgatgtgcaactggtggagtccggggaaccttaggtaacccggggggtcctgagactctcctgtgtggatctggagtcgcgtgactaaatntgatgcacgtggtcgcaggcgccgagggagggctggagtgggtctcgacgtattcatcgtgatcgggaccacaacaacgttacgcggtactccccggtagaacggggcctaattccaaccatctaccaggacacatccgacccaaacgtaccctaccctactacttacgaactaaaagtcgaaacagttacttaaggacgtcggaaacggacgaaccggtcttacggtacttaacccgtttaagtggttcggaccgtaaaggttcggggaccggggttaccttaaaacgttaaacgtttaaaacccgtcgggggtaacctaaacggttttaaatttaaacgtttaaacgttttaaagttttaaacccggggaaagtttaacggggaaaccggtttaccgggttacggggggtccccggacccgggggtaaccccgtaacgggggtttacccg

SEQ ID NO: 314028 - DNA, 542 bp, Homo sapiens
  misc_feature: GZ8MTXP01D3Q0Q.22.41.D08.1.454.CMB.2.raw
  modified_base (329)..(329): a, c, t, g, unknown or other
  misc_feature (329)..(329): n is a, c, g, or t
  modified_base (349)..(349): a, c, t, g, unknown or other
  misc_feature (349)..(349): n is a, c, g, or t
  modified_base (379)..(379): a, c, t, g, unknown or other
  misc_feature (379)..(379): n is a, c, g, or t
  modified_base (464)..(464): a, c, t, g, unknown or other
  misc_feature (464)..(464): n is a, c, g, or t
  modified_base (491)..(491): a, c, t, g, unknown or other
  misc_feature (491)..(491): n is a, c, g, or t
  modified_base (509)..(509): a, c, t, g, unknown or other
  misc_feature (509)..(509): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcctggggcctcagtgaaggtctcctgcaaggcttctggttacacgtttaggagctatggtatcgtttgggtgcgacaggcccctggacaacggcctgagtggatgggatggatgaaacccttntaaagggaaacacaaaactntgcagagaggctccgagggcagagtcaccntgacccgcagacacaccaaacgaccacacgcctacataggaagttgaggagtctagagacctgacgacacggccgtatattacgngcgacgagtagggtcgtttcacgggtnacttatgagtatcttcgnggcaagtggggccaggggccaccgtggctaacg

SEQ ID NO: 314029 - DNA, 664 bp, Homo sapiens
  misc_feature: GZ8MTXP01EI0E3.22.41.D08.1.454.CMB.2.raw
  modified_base (384)..(384): a, c, t, g, unknown or other
  misc_feature (384)..(384): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcggtttgggtgcgacaggcccctggacaacggcctgagtggatgggatggatcgaacccctttagtaaagggaaacacaaactatgacagagagcctcgagggcagacgtcaccngtacgaccgcacgacaccaccaaaccgaccacagacctacagtaggaagttgaggtacgtcgagaacgaccgtaggaaccgggaacgaccggtaccgttaataacttaacgtcggacggaccgggaaggtacggggtaccgttttacgtaacgggttaacggtaacctttaggtaggttaacgttacgttacccgttaggaaccggggttccgaaccgggttcggggggaaccccgtaacgggggccccgttaaccccggttcgggttcccgtaacccgg

SEQ ID NO: 314030 - DNA, 627 bp, Homo sapiens
  misc_feature: GZ8MTXP01COR8Z.22.41.D08.1.454.CMB.2.raw
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
  modified_base (431)..(431): a, c, t, g, unknown or other
  misc_feature (431)..(431): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctctgcaaggcttctggttactacggtttaggagtcttatggttattcggtttgggtgcgacacggcccctggacaacggctggagtggatgggatggatcgaaaccccttagtaaagggaaacaacaaactatagacagagaggccctcgaggcagagtacaccntgaccganacgacacaaccaacgaccacacgacctanacgtaggagttaggaggtagtcgagaacgaccgtggaacggaaccgacgggtaccctagtactttacgcgcggtacggaggtacgggttcgtttcgtacgggtgtaccttagttggaagttacgtcgttcgacggaccgtaacggtcgggggtcccgaacggggtcccttacccggttcgggttaaccttaaccgg

SEQ ID NO: 314031 - DNA, 588 bp, Homo sapiens
  misc_feature: GZ8MTXP01DULC7.22.41.D08.1.454.CMB.2.raw
  modified_base (217)..(217): a, c, t, g, unknown or other
  misc_feature (217)..(217): n is a, c, g, or t
  modified_base (385)..(385): a, c, t, g, unknown or other
  misc_feature (385)..(385): n is a, c, g, or t
  modified_base (481)..(481): a, c, t, g, unknown or other
  misc_feature (481)..(481): n is a, c, g, or t
  modified_base (517)..(517): a, c, t, g, unknown or other
  misc_feature (517)..(517): n is a, c, g, or t
  modified_base (545)..(545): a, c, t, g, unknown or other
  misc_feature (545)..(545): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcctggggcctnagtgaagtctcctgcaaggcttctggttacacgtttagagctatggtatcggttgggtgcgacaggcccctggacaacggcctgagtggatgggatggatcgaaccccttgtaaagggaaacacgaaaactatagacagagaggcctccgagggcaagacgtacaccngtcgaccgcaagacacaaccaaacgacccacacgacctacagtggagttgaggagtcgagacgacctgaacggacacgggtacctagtacttacgngacgacggtaggtacggggtcgtttacgtacgggtnaacgttagtggttaagttactcttacgngggacgaacgggtcgggccgagggccttaccgtggttctaacg

SEQ ID NO: 314032 - DNA, 561 bp, Homo sapiens
  misc_feature: GZ8MTXP01CCEZV.22.41.D08.1.454.CMB.2.raw
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (426)..(426): a, c, t, g, unknown or other
  misc_feature (426)..(426): n is a, c, g, or t
  modified_base (515)..(515): a, c, t, g, unknown or other
  misc_feature (515)..(515): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcggttgggtgcgacaggcccctggacaacggcctgagtggatgggatggatggaaccccttagtaaagggaaacacgaaaactatagacaaggagaggcctccgaggggcagagtacaccngtcgaccgnagacacgaccaacgaccacagctacanggtagttgaggagtcagacgactgacggacgacgggccgtaatattacgtggcgacgagtcggggtcgttttacgacgggtgacttagngagtatcttcgaggcaaggtgggcctagggccacccgtggctaacg

SEQ ID NO: 314033 - DNA, 548 bp, Homo sapiens
  misc_feature: GZ8MTXP01D476H.22.41.D08.1.454.CMB.2.raw
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
  modified_base (403)..(403): a, c, t, g, unknown or other
  misc_feature (403)..(403): n is a, c, g, or t
  modified_base (456)..(456): a, c, t, g, unknown or other
  misc_feature (456)..(456): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgttgggtgcgacaggcccctggacaacggcctgagtggatgggatggatgaacccttgtaaagggaaacacaaaactatgacagagaggcctccagggcagagtcacntgaccgnagacacacaaacgaccanagcctacatggagttgagagtcagagactgacggacacgggcctatattacgngcgagaggtggtcgttcgtacggtgtacttagtgttagtactcgttacgcggcgtaacgggtcggggccgacgggccttaccggtgccgtcg

SEQ ID NO: 314034 - DNA, 623 bp, Homo sapiens
  misc_feature: GZ8MTXP01BZEUI.22.41.D08.1.454.CMB.2.raw
  modified_base (399)..(399): a, c, t, g, unknown or other
  misc_feature (399)..(399): n is a, c, g, or t
  modified_base (429)..(429): a, c, t, g, unknown or other
  misc_feature (429)..(429): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgcaaggcttctggttacacggtttaggagtctagttggtattcggtttgggtgcgacgacggcccctggaccaacggcctggagtggatgggatggatcgaaccccttagtaaacgggaaacaacaaactagtcgacagagacgcctacgaggcagagtaccacgntcgacgcagacacacaacgacacacgctanagtaggagttacgagacgtctacgacgacgtagacgggacgaccggtacgtaatacgtacgtcggcgacggacggtacgggttctttacgagggtctagttagttaggacgttaagtccgttacggacggttcgtaacgggtccgggggaacccgaacggggtcccttaaccccgggttgggttccctaaccgg

SEQ ID NO: 314035 - DNA, 664 bp, Homo sapiens
  misc_feature: GZ8MTXP01EA4DB.22.41.D08.1.454.CMB.2.raw
  modified_base (379)..(379): a, c, t, g, unknown or other
  misc_feature (379)..(379): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagctggggcctcagtgaaggtctcctgcaaggcttctggttacacgtttaggagctatggtatcgtttgggtgcgacaggcccctggacaacggcctgagtggatgggatggatcgaaacccttgtaaagggaaacacaaactatgcagagaggcctccagggcagacgtacacntgaccgcagacacgaccaaacgaccacagcctaacagtagggaagtttgaagggtagtaccgtagaagaccgtggaacgggaaccgaaccggggtaccgttaagtaactttaacgtcggaccggacggacgggtaacgggggtccgttttaccggtaaccggggttaagtaaccgttaagtacgggttaaagttaacgttccgttacggacggggttcctaacggggttcgggggaacccgaacggggggcccttaccccgggttggggttaacccgttaaccgg

SEQ ID NO: 314036 - DNA, 604 bp, Homo sapiens
  misc_feature: GZ8MTXP01ACL52.22.41.D08.1.454.CMB.2.raw
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
  modified_base (450)..(450): a, c, t, g, unknown or other
  misc_feature (450)..(450): n is a, c, g, or t
  modified_base (487)..(487): a, c, t, g, unknown or other
  misc_feature (487)..(487): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagtctagtggtatcgtttgggtgcgacaggcccctggacaacggcctgagtggatgggatggatgaacccttagtaagggaacacaaactagtgacgagagacggcctaccgagggcagagtacaaccntcgaacccgnacgacacaaccaaacgaccacgacgacctacgagtggaagttgaggtagtcgngacgacctgaccgggacgacgggcctaatacttacgngccgtaggagtcgggtcgttaccgtcggtgacgttagtcggaacgtttatccgttacgagggttccaacgggttacgggggaacccgcggggtaccacccggttgggttcctaaccg

SEQ ID NO: 314037 - DNA, 668 bp, Homo sapiens
  misc_feature: GZ8MTXP01BXH4F.22.41.D08.1.454.CMB.2.raw
  modified_base (440)..(440): a, c, t, g, unknown or other
  misc_feature (440)..(440): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagccgtggggcctcagtgaaggtctcctgcaaggtcttcgtggttacacggtttaggagctagtggtagttcggtttgggtgcgacgacggcccctggacaacggcctggaggtggagtgggatggatacgtaaaccccgttagtaaacggggaaacaacgaaactagtagacgaaggaggacggcccgtaccggaggggacaaggacgtaaccaaccgtaagtcggaacccgganaacgaccaaccgaaccaaacgaccaactacgacctacagtgggacttggagagtcgtagacgactacggacgaacggacgggtacctaattacgtaacgtgaccggtacggagggtacgggtcgtttccggtaaggtgtaacgttagtgaacggttatcgttacggacggcgtaacgggtcgggggaacccgacggggcccgttacccggttcgggttccgttaaccg

SEQ ID NO: 314038 - DNA, 573 bp, Homo sapiens
  misc_feature: GZ8MTXP01AMMXW.22.41.D08.1.454.CMB.2.raw
  modified_base (377)..(378): a, c, t, g, unknown or other
  misc_feature (377)..(378): n is a, c, g, or t
  modified_base (384)..(384): a, c, t, g, unknown or other
  misc_feature (384)..(384): n is a, c, g, or t
tcagacatacgcgtcacgaccggtgctcgatttagtcacgcgagaaagggaaagggacccaaaaaccacaccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacaggcccctggacaacggcctgagtggatgggatggatcgaacccttgtaaagggaacacaaactatgacagagaggcctacgaggcagagtacacnngaccgnacgacacaccaacgaccacacgacctacatcggagttgaggtagtcgtagacgaccgtgaacggacgacgggtacctagttaactacgtgccgacggaggtacgggtcgtttacggacggtgaacttgtagaggtaactcttcgaggcaacggtcggggaaccaggggccaccccgtgggttcctaacg

SEQ ID NO: 314039 - DNA, 626 bp, Homo sapiens
  misc_feature: GZ8MTXP01A1WDK.22.41.D08.1.454.CMB.2.raw
  modified_base (413)..(413): a, c, t, g, unknown or other
  misc_feature (413)..(413): n is a, c, g, or t
  modified_base (487)..(487): a, c, t, g, unknown or other
  misc_feature (487)..(487): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcggtttgggtgcgacaggcccctggacaacggcctgagtggatgggatggatcgaacccttagtaaagggaaacacaaactatgacagagaggcctaccgagggcagagtacaccaatcgaccgcagacacaccaacgacccanacgacctacagtggagttggaggagtctagaacgtaaccgtaaacggacgacggggtaccttaatacgttacgngacggacggaggacggggtccgtttacggtacgggtaggtaacttagttacggtagttacgtccgtcggaacgggttccgaccgggtcgggggacccgtaacgggggccctaccccgggttggtccgaacgtttcccgg

SEQ ID NO: 314040 - DNA, 536 bp, Homo sapiens
  misc_feature: GZ8MTXP01DE0SH.22.41.D08.1.454.CMB.2.raw
  modified_base (325)..(325): a, c, t, g, unknown or other
  misc_feature (325)..(325): n is a, c, g, or t
  modified_base (381)..(381): a, c, t, g, unknown or other
  misc_feature (381)..(381): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
  modified_base (458)..(458): a, c, t, g, unknown or other
  misc_feature (458)..(458): n is a, c, g, or t
  modified_base (497)..(497): a, c, t, g, unknown or other
  misc_feature (497)..(497): n is a, c, g, or t
tcagacatacgcgtcacgaccggtgctcgatttagtcacgcgagaaagggaaaggggacccaaaaccacaccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgttggtgcgacaggcccctggacaacggcctgagtggatgggatggatgaacccttntaaagggaaacacaaaactatagcaagagacggctccagggcaagagtcaaccaangaccgcagacacaccaaacgaccanancacatgaagttgagagtcngagacctgacgacacggccgtatattaacgngcgcgaggtcggtcttcgaggtgacgttatgagtactcncgcgcgaaggcgggcgacggccgttaccgtgttcgtaac

SEQ ID NO: 314041 - DNA, 636 bp, Homo sapiens
  misc_feature: GZ8MTXP01CUK59.22.41.D08.1.454.CMB.2.raw
  modified_base (539)..(539): a, c, t, g, unknown or other
  misc_feature (539)..(539): n is a, c, g, or t
tcagacatacgcgtcacgaccggtgctcgatttagtcacgcgagaaagggaaaggggacccaaaaaccacacccctccttgggagaatccctagatcacagctcctcaccatggactggacctggagcattccttttcttggtggcagcagcaactggtgcccgctctcaggttcaattggtgcagtctggacctgaggtgaagaagccgtggggcctcgagtgaaggtctcctgcaaggtcttgtggttactacggtttaggagtcttagtggttattcggtttgggtgtcgacacggcccctggaccaacggcctggagtggagtgggatggatcgaaaccccttagtaaagggaaacaacgaaactagtgacagaggagccctaccgaggggctagacgtaccaaccgtgacgaaccgacgaacgaaccaacccgaaacccgaaacgaacccaacgacgacctaacgaggtaggtagttaggaaggtacgtcgagacgtaccgtaggacggaacgacggtacctaatacgttacgnggcgacggtagtagggtccgtttcgaggtcgtaattagtgagttatcgttacgaggcgtaacggcggggccagggccttaccgtcggttccgtaacg

SEQ ID NO: 314042 - DNA, 851 bp, Homo sapiens
  misc_feature: GZ8MTXP01CK4HC.22.41.D08.1.454.CMB.2.raw
tcagacatacgcgtcacgaccggtgctcgatttagtcacgcgagaaagggaaagggacccaaaaccacaccctccttgggagaatccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagtctatggtatcgtttgggtgcgacaggcccctggacaacggcctgagtggagtgggatggataggtaaacccctttactaaacgggggtaaaacaaccgtaaaactagtagacaaggaggaacgggccccgttaccgaacgggggaccgaaggaacggttaacccaaccccgaagtcgaaacccccggacgaacggaaaccaacccggaaaccccaaaacccgggaaccccaaacccgaaaccgggtacccctaaacccgtaaacgttacgggggtaaacggttttacggggaaagggtaacgggttaacccgttagggtaaacgggaaccccgtttacgggaaacccgggggaaccgtaaacccggggtaaccccgggtttaaatttaacgtttaaacccgtttgggaccggtacccggggaaggtaacggggggtccggtttttaaccgttacccgggggtttaagaaacccgtttaggttcgttaaacgggttaaagttccgtttaaccggaggggaccttaaccgggtccggggggtaacccgtaacgggggccccgttaaccccgttcgggggttaaccctttaacccgg

SEQ ID NO: 314043 - DNA, 556 bp, Homo sapiens
  misc_feature: GZ8MTXP01EW68M.22.41.D08.1.454.CMB.2.raw
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
  modified_base (350)..(350): a, c, t, g, unknown or other
  misc_feature (350)..(350): n is a, c, g, or t
  modified_base (381)..(381): a, c, t, g, unknown or other
  misc_feature (381)..(381): n is a, c, g, or t
  modified_base (444)..(444): a, c, t, g, unknown or other
  misc_feature (444)..(444): n is a, c, g, or t
  modified_base (469)..(469): a, c, t, g, unknown or other
  misc_feature (469)..(469): n is a, c, g, or t
  modified_base (516)..(516): a, c, t, g, unknown or other
  misc_feature (516)..(516): n is a, c, g, or t
  modified_base (534)..(534): a, c, t, g, unknown or other
  misc_feature (534)..(534): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcctggggcctnagtgaggtctctgcaaggcttntggttacacgtttaggagctatggtatcggtttgggtgcgacacggcccctggaccaacggcctggagtggatgggatggatgaacccttagtaaagggaaacacaaactntgcagagaggcctccgagggcagcgtacacngtgaccgcagacacaccaaacgaccacacgacctacagtggaagttgaggagtcagactacgngacggacacgggccgtatacttacnggacgcgaggtagggtcgtttcgaggtgacttagtgagtatcttcgnggcgtaacgtgggggccncgggccaccggtggttctaacg

SEQ ID NO: 314044 - DNA, 656 bp, Homo sapiens
  misc_feature: GZ8MTXP01D25BG.22.41.D08.1.454.CMB.2.raw
  modified_base (469)..(469): a, c, t, g, unknown or other
  misc_feature (469)..(469): n is a, c, g, or t
tcagacatacgcgtcacgaccggtgctcgatttagtcacgcgagaaagggaaagggacccaaaaaccacacccctccttgggagaatccctagatcacagctcctcaccatggactggacctggagcattccttttcttggtggcagcagcaactggtgcccgctctcaggttcaattggtgcagtctggacctgaggtgaagaagcgtggggcctcagtgaaggtctcctgcaaggcttctggttactacggtttaggagtctagtggtattcggtttgggtgcgacgacggcccctggacaacggcctggaggtggagtgggatggattacgaacccgttagtaaacgggaaaacaactaaaactagtagacgaaggacggacggccctaccgaggggaccagtacgtaaccaaccaagtacgaaccgacacgaccaacgaaccaaacgaccaacacgacctacagnggtagttggaggtagtcgagaacgacgtcgaacgggacgtaacggtaccgttaatacgttaacgtcggacggacggtaggtacgggtcgtttacggtacggtaagtaacttatggttagtaagtccgttagcggaccgtaagggtacgggggcccaagggggcccttacccggtcgggttaacctcg

SEQ ID NO: 314045 - DNA, 591 bp, Homo sapiens
  misc_feature: GZ8MTXP01AREZ2.22.41.D08.1.454.CMB.2.raw
  modified_base (396)..(396): a, c, t, g, unknown or other
  misc_feature (396)..(396): n is a, c, g, or t
  modified_base (436)..(436): a, c, t, g, unknown or other
  misc_feature (436)..(436): n is a, c, g, or t
  modified_base (470)..(470): a, c, t, g, unknown or other
  misc_feature (470)..(470): n is a, c, g, or t
  modified_base (501)..(501): a, c, t, g, unknown or other
  misc_feature (501)..(501): n is a, c, g, or t
  modified_base (529)..(529): a, c, t, g, unknown or other
  misc_feature (529)..(529): n is a, c, g, or t
tcagacatacgcgtcacgaccggtgctcgatttagtcacgcgagaaagggaaagggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgcaaggcttcgtggttacacggtttaggagctagtggtatcggtttgggtgcgacaggcccctggacaacggcctgagtggatgggatggatgaacccctttgaaagggaacacaaactagtgacagagacggcctaccgagggcagagtacacctgcgaccgnacgacacgaccaacgaccactagcctacagtgagttgagngtcgagacacgtgacggacgacggtctatatcgngcgtacggaggtagggtcttacgtacgggtntaacgttagtgagtaacgtcgttaccgngggccgtaacgggtcggggaacccgtacgggggacccttacccgggttcggttccgtaacgg

SEQ ID NO: 314046 - DNA, 628 bp, Homo sapiens
  misc_feature: GZ8MTXP01CUY4V.22.41.D08.1.454.CMB.2.raw
  modified_base (398)..(398): a, c, t, g, unknown or other
  misc_feature (398)..(398): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgcaaggcttcgtggttacacgtttaggagtctagtggtatcggtttgggtgcgacaggcccctggacaacggcctgagtggatggatggatcgaacccttgtaaacgggaacacaaactatagacagagaggccctcggaggcagagtaaccacaagtcgacccncaacgacaaccacccgaaaccaccacacgcctaacagtggtaggttcgaaggtcgttacgagacgaccgttagaaccgggacggaaccggtacgttaacttagttacgtcggacgccggaagggtacgggtccgtttacgtagggtaacaacgttagtcgagttagtcgttcgacggccgtaacgggtcgggaaccgtcggggacccttacccggtcggttccgtaaccg

SEQ ID NO: 314047 - DNA, 621 bp, Homo sapiens
  misc_feature: GZ8MTXP01D0OSN.22.41.D08.1.454.CMB.2.raw
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggactgaggtgaagagctgggcctcagtgagtctctgcaggcttctggttacacgtttaggagctatggtatcggttgggtgcgacaggcccctggacaacggctgagtggatgggatggatgaaccccttagtaagggaaacacaaactatgacagagaggcctccgagggcagagtacacntcgaccgnacgacacacaacgacacacgctacagtggagttgaggagtcgtagacgtaccgtaggaccggggaaccgtaccgggtacccgttaagtacgtttaaccgtgggaccggacgggtagggtaacgggggttccgtttacgtacgggtaacgtaacgttagtaggttaggttacttacgcggacggttccgtaaccgggtgggggaaccccgagggggtacccgcccgttcggggttctaaccg

SEQ ID NO: 314048 - DNA, 702 bp, Homo sapiens
  misc_feature: GZ8MTXP01BKFHW.22.41.D08.1.454.CMB.2.raw
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacggtttaggagctatggtatcggtttgggtgcgacacggcccctggacaacggcctgagtggatgggatggatcgtaaaccccttagtaaagggaaacaacgaaaactagtacggacaaggagacggcccctaccggaggggcaagacgtaccaaccgaagtcggaacccgcaacgaccaaccaaccgaaaccgacccaacacgaccctaacgagtagggaaggttaggacggtagtcgttagacgtacccgtaggaccggggaaccgtaccggggtaccgttaattacgttaccgcgggaccgaccggggtaaggtccgggggttaccgttttaccgggtaccggggttaagtaaccgttaagtaggttaacggttaacttccgttacggttacgggccgaaccgggttcggggggcctacgggggcccttacccggtgggttccctaacg

SEQ ID NO: 314049 - DNA, 627 bp, Homo sapiens
  misc_feature: GZ8MTXP01D5XBK.22.41.D08.1.454.CMB.2.raw
  modified_base (345)..(345): a, c, t, g, unknown or other
  misc_feature (345)..(345): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
tcagacatacgcgtcacgaccggtgctcgatttagtcacgcgagaaagggaaagggacccaaaaacacaccctccttgggagaatccctagatcacagctcctcaccatggactggacctggagcatccttttcttggtggcagcagcaactggtgcccgctctcaggttcaattggtgcagtctggacctgaggtgaagagcctggggcctcagtgaggtctctgcaaggcttctggttacacgtttaggagctatggtattcggtttgggtgcgacaggcccctggacaacggcctgagtggatgggatggatcgaacccttgtaaagggaaacacaaaactntgacagagaggcctcgagggcagagtacacntgaccganagacacaacaacgacacacgctacagtaggaagttgaacggagtcgtagacgaccgtaggaacggggacgaacgggtaccgtaagttaattaaccgtggccggacggaacggtacggggttccgttttacgtacgggtaagtaacgttagttggaacgttaacgttccttacggacgggttaccgtaacgggttcgggggaacccgaacgggggcccttaaccccggttgggttcctaaccgg

SEQ ID NO: 314050 - DNA, 689 bp, Homo sapiens
  misc_feature: GZ8MTXP01BHAL1.22.41.D08.1.454.CMB.2.raw
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggtttaattggtgcagtctggacctgaggtgaagagccgtgggcctcagtgaaggtctcctgcaaggtcttcgtggttacacggtttaggagtcttagtggttattcggtttgggtgtcgacgacggcccctggaccacggcctggagtggagtgggatggactacgtaacccgttagaaagggaaacactaaactatacgacagagacgctaccgaggacagacgtacaaccagcgaccgcaacgaccacaacccgaacgacccacacgacctacgagtcggtagttagggacggtacgtacgtacgacgaccgtagacccgtacggaccggtacgttaactacgttaccgtggcccggtaggtacggtacggggttacccgttttacgggtaccggttcgggtaacttaggttacggtaacgttacgtaccgtcgggttaaccggaccgttacgggcccgggggtaaccgaaccggggtccccgtaacccgggttcggtaaccgttcgttcccccgg

SEQ ID NO: 314051 - DNA, 620 bp, Homo sapiens
  misc_feature: GZ8MTXP01ALDI8.22.41.D08.1.454.CMB.2.raw
  modified_base (410)..(410): a, c, t, g, unknown or other
  misc_feature (410)..(410): n is a, c, g, or t
  modified_base (558)..(558): a, c, t, g, unknown or other
  misc_feature (558)..(558): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgcaaggcttctggttacacgtttaggagtctatgggtattcggtttgggtgcgacgacggcccctggacaacggcctggagtggatgggatggatacgaaccctttagaaacgggaaacaacaaactatagacagaaggaggccctaccggaggggcaaggacgtaaccaacccgtntcggaacccgcgaacgaccaaccaaacccgaaaccgacccacaacgcctacagtaggacggttgaggagtcgtagacgacgtaggaacggtacgacggtaccgtattacgtacgtgacggacgaggtacgggtcgtttacgtcgggtntacgttagtcgagtatcgcgttcggcgaacggtgggccgagggccttaccgtcggttctccg

SEQ ID NO: 314052 - DNA, 601 bp, Homo sapiens
  misc_feature: GZ8MTXP01DM140.22.41.D08.1.454.CMB.2.raw
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgagtgaagagctgggcctnagtgagtctctgcagctntgttacacgttagnctatggtatcgttggtgcgacaggccctggacaacggctgagtgatgggatggatacgaaccttagtaaacgggaaacacaaactatgacagagagcctccgaggcagagtaccacngtgacccgnaacgacacaccaaacgaccacacgacctacagtaggtagttacggaggtacgtctagaacgtaccgtcggaacggaccgacgggtaccttaagtacttacgtggcggacggtacggtacgggttccgtttacgtacgggtaacgtaacgttagtgttaagttactcgttacgaggttaccgaacgggtcggggcccgtaggggcccttacccggtggttaacctaacgg

SEQ ID NO: 314053 - DNA, 631 bp, Homo sapiens
  misc_feature: GZ8MTXP01BQXK4.22.41.D08.1.454.CMB.2.raw
  modified_base (568)..(568): a, c, t, g, unknown or other
  misc_feature (568)..(568): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcggtttgggtgcgacaggcccctggacaacggctgagtggatgggatggatcgaacccttagaaagggaaacacaaactatagacaaggagaggcctccgagggctagagtaccaccaagtcgaaccgcaacggaccaccaaccaaaccgaccaacgacgacctacagtgggaagttggaggtagtctaggacgaccgtaggacgggaacgaccgggtacccgtaattaacttaccgtggaccgacggtaggacggggtctttccggacggtgtaacttagtggagttactcgttacgngggacccgtaacggttcgggggaacccgtaacgggggcccacccgggttcgggttctaaccgg

SEQ ID NO: 314054 - DNA, 762 bp, Homo sapiens
  misc_feature: GZ8MTXP01BEHVC.22.41.D08.1.454.CMB.2.raw
  modified_base (215)..(215): a, c, t, g, unknown or other
  misc_feature (215)..(215): n is a, c, g, or t
  modified_base (707)..(707): a, c, t, g, unknown or other
  misc_feature (707)..(707): n is a, c, g, or t
tcagacatacgcgtcacgaccggtgctcgatttagtcacgcgagaaagggaaagggacccaaaaaccacacccctccttgggagaatcccctagatcacagctcctcaccatggactggacctggagcattccttttcttggtggcagcagcaactggtgcccgctctcaggttcaattggtgcagtctggacctgagtgaagagcgtgggcctnagtgaaggtctctgcgaaggtcttcgtggttactacggttttaggagtcttagttgggttagttcggtttgggtgacggtacgaccgggccccgtaggaaccgaacggtccgtaggacggtggaggtggggagttgggaataccggtaaaccccgtttaacgtaaaacggggaaaacctaaacgtaaaacttagtacggaccgaaagggaacggacggtcccctaccgggaagggaccgaacggaacgttaacccgaaaccgtaagtacccggaacccgaacgaaaccggaaacccaaacccgaaaaccccgaaaacccgaacccctaacaaaccggaccctaaaacgtagtaacgggttaaggttagaacgggttagtaccgtagaacgaccgtaggaaccgggaacgtacgggtaccgtaataacgttcgacggcgaccggtagggtacgggttcgttacggtaggtcgaattgtacgttagtacgttcncggttcggactaacggggcggaaccgtacgggccttacccggtgaaccgtaaccg

SEQ ID NO: 314055 - DNA, 688 bp, Homo sapiens
  misc_feature: GZ8MTXP01AUQ1M.22.41.D08.1.454.CMB.2.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (276)..(276): a, c, t, g, unknown or other
  misc_feature (276)..(276): n is a, c, g, or t
  modified_base (403)..(403): a, c, t, g, unknown or other
  misc_feature (403)..(403): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgcaagcttntggttacacgttaggntctatggtatcggttggngcgacacggcccctggaccaacggcctggagtggagtgggatggatacgtaacccttagaaagggaaacaacgaaactagtagacgagaggacggccctaccggagggcaagtacgtaaccaaccgngacgacccgacaacgaccaaccaacccaaaccgacccaacgacgacctaacgagtaggtaacggttggaaggtacgttcgaggaaccgtaccgtacgggaaccggtaaccggacgggtaccgttaaacttacgttaccgtcggaccggacgggtaacggtcggggttaccgtttacggtaaccggtaagtaacttagttacggaacgttactcgttacggagggttacccgtaacgggtcggggaaccctacggggacccttaccggtcggttaacgttaacccg

SEQ ID NO: 314056 - DNA, 704 bp, Homo sapiens
  misc_feature: GZ8MTXP01A8DR6.22.41.D08.1.454.CMB.2.raw
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcctggggcctcagtgaaggtctcctgcaaggcttctggttacacgtttaggagtctatggtattcggtttgggtgcgacgacggccccctgggaccaacggcctggaggtggatggggatggatcgaaccctttagaaagggaaacacaaactatcgacagagaggccctccgaggggcaaggacgtaaccaaccgaagtcggacccgacaacgaaccaacaacccaaacgacccaacaacggtcccaacagtagggtaagttaggaggtacgtcgaggaacgaccgtaggaaccggggacggtccggtaccgttaagtacttacgtcggacggaccggtaaggtacgggggttccgttttacggtaacccgggttgtaaaccgttaggttaggaaacgttacgttcgttaccgggacgggttacccgtaaccgggggttcgggggaacccgtaaccgggggcccttaaccccggggttgggttaacccttaacccgg

SEQ ID NO: 314057 - DNA, 641 bp, Homo sapiens
  misc_feature: GZ8MTXP01B5GFF.22.41.D08.1.454.CMB.2.raw
  modified_base (218)..(218): a, c, t, g, unknown or other
  misc_feature (218)..(218): n is a, c, g, or t
  modified_base (414)..(414): a, c, t, g, unknown or other
  misc_feature (414)..(414): n is a, c, g, or t
  modified_base (464)..(464): a, c, t, g, unknown or other
  misc_feature (464)..(464): n is a, c, g, or t
  modified_base (537)..(537): a, c, t, g, unknown or other
  misc_feature (537)..(537): n is a, c, g, or t
tcagacatacgcgtcacgaccggtgctcgatttagtcacgcgagaaagggaaagggacccaaaaaccacacccctccttgggagaatccctagatcacagctcctcaccatggactggacctggagcattcctttttcttggtggcagcagcaactggtgcccgctctcaggttcaattggtgcagtctggacctgaggtgaagaagcgtggggcctnagtgaaggtctcctgcaaggtcttcgtggttacacggttttaggagtctagttggtattcggtttgggtgacgacgacggcccctaggaccaacggcctggaggtggagtgggatggatacgtaaccccttaagaaacgggaaacacggaaactagtagacaagaggagccctaccgagggcagacgtaacaaccntacgaccgcaacgaacaaccaaccgaaaccgacccacaacgtaccctaanaagttggaagtttagggaaggtagtccgagaacgaccgtaggaccgaacgacgggtacctaattacgttacgngcgacggaggtacgggttctttacgacgggtaataacgttagtaggttatgtcgttacgaggccgaaggtcgggaaccgacgggtccacccgtgttccgtaacg

SEQ ID NO: 314058 - DNA, 632 bp, Homo sapiens
  misc_feature: GZ8MTXP01EJJI1.22.41.D08.1.454.CMB.2.raw
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (591)..(591): a, c, t, g, unknown or other
  misc_feature (591)..(591): n is a, c, g, or t
  modified_base (600)..(600): a, c, t, g, unknown or other
  misc_feature (600)..(600): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgagtgaagagctgggctcagtgagtctctgcagcttctgttacacgtttagnctatgtatcggttggngcgacgcggccctggacaacggctggagtggagtggatggatacgaacccgttagtaaagggaaacaacaaactagtagacaggagaggccctacggaggcgaagacgtaacccacaagcgaacccgacaacgaaccaaccgaaacccgaaacgaacccacgaacgtacctaacgagtagggtaaggttagaggtacgttacgaggaacgtaaccgacggaacgggaaccgtaacgggtcccgttaattaaccgtttacgcgacggaccggaaggtacgggtacgttttacggaccggtaagtacttagtagttagtactcgttacgngcgtaacgnggggaaccgtcgggaccttccgtggctaaccg

SEQ ID NO: 314059 - DNA, 605 bp, Homo sapiens
  misc_feature: GZ8MTXP01CELMC.22.41.D08.1.454.CMB.2.raw
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
  modified_base (456)..(456): a, c, t, g, unknown or other
  misc_feature (456)..(456): n is a, c, g, or t
tcagacatacgcgtcacgaccggtgctcgatttagtcacgcgagaaagggaaagggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgcaaggcttcgtggttacacgtttaggagtctagtggtatcggtttgggtgtcgacgaggcccctggacaacggcctgagtggagtgggatggatcgaacccctttagtaaagggaaacaacaaactatgacagagaggccctccgagggcagagtacaccngtnaaccgnaacgacaacaaccaaacgacccanacgacctanatggaagttgaggtatacgngaacgaccgtaggacggaacgtaccggggtacccttaaagttaactttaacgcggcgaccggaggtaacggggttctttcgagggtaacgtaacttagtgaagttactcttacgaggcaaggtgggccagggccaccgtggcgtaaccg

SEQ ID NO: 314060 - DNA, 644 bp, Homo sapiens
  misc_feature: GZ8MTXP01AVPXT.22.41.D08.1.454.CMB.2.raw
  modified_base (414)..(414): a, c, t, g, unknown or other
  misc_feature (414)..(414): n is a, c, g, or t
  modified_base (579)..(579): a, c, t, g, unknown or other
  misc_feature (579)..(579): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaatttggtgcagtctggacctgaggtgaagaagccgtggggcctcgagtggaaggtctctgacgaaggtcttcgtggttactacggtttaggatctagtggtattcggttggtgcgacgacggcccctaggaccgaacggccgtagagtggagtgggatggatacgtaacccttacgaaaggaaccaacaaacttagtgacgagaggacggtccaccgagggacgagacgtaaccaccngtacgaccgacacgaaccaccaaaccaaccgacccaatacgaccctagagtggtagtagaggtagtcgacgaagaccgtggaaccgggacgaccggggtacttaacgtacgtaccgtggaccgacgggtacggtaggggttcctttagaccgggtaataacgttntaggacgttagtcgttacgagccgtaacggggcggaaccgtacgggcccttacggtcggttctcg

SEQ ID NO: 314061 - DNA, 585 bp, Homo sapiens
  misc_feature: GZ8MTXP01EGMME.22.41.D08.1.454.CMB.2.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (385)..(385): a, c, t, g, unknown or other
  misc_feature (385)..(385): n is a, c, g, or t
  modified_base (431)..(431): a, c, t, g, unknown or other
  misc_feature (431)..(431): n is a, c, g, or t
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgagtgaagagctgggcctnagtgagtctcctgcaaggcttctggttacacgtttagganctatggtatcggttgggtgcgacgacggcccctggacaacggcctgagtggagtgggatggatacgtaacccttagtaaagggaaacaactaaactatgacagagacgcctaccgaggcagagtaaccacntcgaccgcaacgaccaacaaccaaaccgaccaacgacgaccctaanagtaggtaggttagaggtacgtcgagacgactacgacggacgacggtacgtatattacgngcgacgngtacgggtcgttacgcggtaatacgttagtaggagtactcgttcgcggcgaacgggtgggccgacgggcttaccgtggttctaaccg

SEQ ID NO: 314062 - DNA, 619 bp, Homo sapiens
  misc_feature: GZ8MTXP01BTODJ.22.41.D08.1.454.CMB.2.raw
  modified_base (367)..(367): a, c, t, g, unknown or other
  misc_feature (367)..(367): n is a, c, g, or t
  modified_base (399)..(399): a, c, t, g, unknown or other
  misc_feature (399)..(399): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgcaaggtcttcgtggttactacggtttaggagtctagttggtattcggtttgggtgcgacgacggcccctggacaacggcctggaggtggagtgggagtggatcgtaaccctttagaaagggaaacacaaactntgacagagaggccctcgaggcagcgtaccacngtcgaccgacacgacaccacgaaaccactacacgaccctacgagtaggacgttaggaggagttcgagacgtaccctaggaaccggacgtacggtaccgtaatacgttacgcgtcggacggagggtacggggtcgtttacggaacggtgaaacgttgtaggagtctcgttcgacgggttcaacgggtggggccctaggggcccttaccgtgggttcgtccg

SEQ ID NO: 314063 - DNA, 694 bp, Homo sapiens
  misc_feature: GZ8MTXP01BX282.22.41.D08.1.454.CMB.2.raw
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcattccttttcttggtggcagcagcaactggtgcccgctctcaggttcaattggtgcagtctggacctgaggtgaagagcgtgggcctnagtgagtctctgcagtcttntgttactacgtttaggagtctagttggtagttcggttgggtgcgacgacggcccgtggacacggctgagtgagtggatggatacgaacccgttagtaaacgggaaacaacgtaaatagtagacgaagaggacgcctaccggaaggcaagacgtaaccaaccaagtacgacccgacgaacgaaccaaccgaaacccgaaaccgacctaacgacgtacccgtaagacgtaggggtagttagggacggacgttacgacggaacgtaacccgttacgggaaccgggaacggtaaccgggtaaccgtttaaacgttaacgttaccgacggtaccggaacgggtacggggttaaccgggttccgtttaacccggtaggtaagtaaaccgtttaggacgttgttaacgtcgttacgcggaccgtcgggcgggaacacggggccttaccggtcggttaactccgg

SEQ ID NO: 314064 - DNA, 528 bp, Homo sapiens
  misc_feature: GZ8MTXP01AW6Y8.22.41.D08.1.454.CMB.2.raw
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (430)..(430): a, c, t, g, unknown or other
  misc_feature (430)..(430): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (479)..(479): a, c, t, g, unknown or other
  misc_feature (479)..(479): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgccccgctctcaggttcaattggtgcagtctggacctgaggtgaagaagcctggggcctcagtgaaggtctcctgcaaggcttctggttacacgtttaggagctatggtatcggttgggtgcgacgaggcccctggacacggctgagtgatgggatggatgaaccttcgtaagggaacanaaactntgcagagaggcctaccgagggcagagtacacaatgaccgnagcacacacgcancgtaccananggaactggagatctgagtaccngacgcgtacggcctagtaattccgngacgngagtggtcgttacgcggtntacgttgtgagtctncgnggcnggtcgggcgacggccacgtgttaactg

SEQ ID NO: 314065 - DNA, 668 bp, Homo sapiens
  misc_feature: GZ8MTXP01B21GO.22.41.D08.1.454.CMB.2.raw
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcgtggggctnagtgagtctctgcagcttntgttactagttaggagcttagtggtagtcgttgggncgacncggcccctggacaacggctgagtggagtggatggatcgaacccttagaaacgggaaacaacaaactagtgacgaagaggacgccctaccggaggcagacgtaaccaacccgaagtcgaacccgcaaacgacccaaacgaaacccaaaccgaaccctacgaacgacctaacgagttacgggtaacgttaggaaggtacgtctaaggacgtaacgtcggaaccggaacgtaccggtaccgtaattaacgttcgtacggccggtacggaaggtacggggttaccgtttcgtacgggttaacgtaacgttgtttaggaagttaacgtcttcggacgggaccgtaacgggtccgggggccgtaacggggtcccgttacccgttcggttcgtaacccg

SEQ ID NO: 314066 - DNA, 611 bp, Homo sapiens
  misc_feature: GZ8MTXP01A8EQN.22.41.D08.1.454.CMB.2.raw
  modified_base (416)..(416): a, c, t, g, unknown or other
  misc_feature (416)..(416): n is a, c, g, or t
  modified_base (514)..(514): a, c, t, g, unknown or other
  misc_feature (514)..(514): n is a, c, g, or t
  modified_base (542)..(542): a, c, t, g, unknown or other
  misc_feature (542)..(542): n is a, c, g, or t
  modified_base (552)..(552): a, c, t, g, unknown or other
  misc_feature (552)..(552): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgcaaggtcttcgtggttacacgttttaggagtctagtggtagttcggtttgggtgcgacgacggccctggacgaaccggctaggaggtggatgggagtggatacgtaacccttagtaaacgggaaactaacgaaatgtagacgagagacggccctacggaggacgtaggacgtacccaaccgngacgacccgacacgacaacccaaccaaaccgaccaactacgacctacagtggagtgagtacgtcgagactacgacgacggacgacgcgtatactacgngcgagtaggtcgggttacttcgtaggtntaacgttagngttagtctcgcgaggccgtaacgggtcgggccgtacgggccgacccgtggttcctaacg

SEQ ID NO: 314067 - DNA, 682 bp, Homo sapiens
  misc_feature: GZ8MTXP01CL6TD.22.41.D08.1.454.CMB.2.raw
  modified_base (219)..(219): a, c, t, g, unknown or other
  misc_feature (219)..(219): n is a, c, g, or t
  modified_base (406)..(407): a, c, t, g, unknown or other
  misc_feature (406)..(407): n is a, c, g, or t
  modified_base (414)..(414): a, c, t, g, unknown or other
  misc_feature (414)..(414): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaagtgaagaagccgtggggcctnagtgaaggtctcctgcaaggctttcgtggttacacgttttaggagtcttatggtattcggtttggggtgcgacgacggccccgtaggacaacggcctggagtggagtgggatggatacgaacccttacgtaaagggaaacacgaaaactagtagacgagagagccctacgaggcagacgtaccaccnncgaccgnacgacacaaccaaacgaccacacgacctaacagtggtaagttggaaggtacgttcgaggaacgtaccgtacggaaccgggaaccgtaacccggtaccggttaaattaacgtttaacgcggaccggtacgggacgggtacggggttaccgtttaccggttacgggtaagtaacgttagtaggacgttaacgtcgttaccggacgggttccgtaacggggtcgggggaacccgacggggtccccttacccggtcgggttcccgtaaccgg

SEQ ID NO: 314068 - DNA, 673 bp, Homo sapiens
  misc_feature: GZ8MTXP01EMIDF.22.41.D08.1.454.CMB.2.raw
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgacaaggtcttcgtggttactacggttttaggagtctagttggtatcggtttggtgcgacacggccctggacaacggcctgaggtggagtggagtggatcgtaacccttagtaaacgggaaacaacgtaaactagtacgacgagaagacggccctaccgagggacagacgtaaccaacaagtacgaaccgcaacgaaccaacgaaacccaaacgacccaaacgacgacccctaacgaaggtaggtaaggttaggaacgggtacgtacggtagaccggaaccgttacgaaccgggaacggtacggtaccgttaagttacgtacgtcggacggaccggtaggtaacgggttcgtttacggacggttaatacgttagtagttagttacgtcacgttacgcgtaacggcgggccggtacggcccgttaccgtcgttcgtaaccg

SEQ ID NO: 314069 - DNA, 646 bp, Homo sapiens
  misc_feature: GZ8MTXP01CVOZ6.22.41.D08.1.454.CMB.2.raw
  modified_base (402)..(402): a, c, t, g, unknown or other
  misc_feature (402)..(402): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagccgtggggcctcgagtgaaggtctcctgcaggcttcgtgttacacggtttaggagctagtggtattcggtttgggtgcgacgacggcccctaggacaacggcctggagtggagtgggatggactcgtaaccccgttagtaaagggaaaccactaaactatgacaggagacggccctccgagggcagacgtaccacngtcgacccgcgagaccacaaccgaacgaccacgacgacctacagtagtaacggtgaggacgtcgtagaacgtaccgtaggaaccggggacgtaacgggtccttaagttaacgttacgtcgacgggacggtacgggtaacggggttccgtttaccggttacgggtgtaacgttagtcggttaagttacgtcgttacgcggccgtaacggcggggaaccctcggggcccaccggttggttcgtccg

SEQ ID NO: 314070 - DNA, 724 bp, Homo sapiens
  misc_feature: GZ8MTXP01B0PP5.22.41.D08.1.454.CMB.2.raw
tcagacatacgcgtcacgaccggtgctcgatttagtcacgcgagaaagggaaagggacccaaaaaccacaccctccttgggagaatcccctagatcacagctcctcaccatggactggacctggagcatccttttcttggtggcagcagcaactggtgcccgctctcaggttcaattggtgcagtctggacctgaggtgaagaagcctgggcctcagtgaaggtctcctgcaaggcttcgtggttacacgttttaggatctaagtggtattcggtttgggtgcggacaggtccccctggaaccaacggcctggacgtggatgggatggatcggaacctttagaaagggaactaacgaaactatagactaagagacggaccctaccgaggggacaaggacgttacaaccctgtacgaacccgctaaacgaccaacgaaacccaacggacccaacacggaccacgagtaggacgtttagaaggtacgttcgaggacaaccgtacggaaccggaacgtaaccggggtaccgttaagtttaactaccgttacggacggaaccggtaggggtaacggggttaccgtttttaacgtaaccggggtaacgttaaacgttaccgttaggttaacggtttaactccgtttaacggacgggttacccgtaaacgggttccggggggaacctaaccgggggtcccttaaacccggttcggggttcctaacccggg

SEQ ID NO: 314071 - DNA, 735 bp, Homo sapiens
  misc_feature: GZ8MTXP01CDQ4N.22.41.D08.1.454.CMB.2.raw
tcagacatacgcgtcacgaccggtgctcgatttagtcacgcgagaaagggaaagggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctgagtgaaggtctctgcgaaggtcttcgtggttactacggtttaggagtcttagtggtagttcggtttgggtgcgacgacggcccctggaccgaacggccgtggaggtggagtgggagtggatacgaacccttaggtaaacggaaacaactaaactagtgacaagagacggccctaccggaagggtcaagacgtaacccaacaagtcgaacccgacaacgaaccaaccgaacccaaaccgacccgaacaacggtaccctaagacgttagggaaggttcggaaggtacgttacgtacggaacgtaccgtacgggaacccggggtaacgaacccggggttacgttaaacgttaacgtttaccggcggaccgggaccggaaggttaccggggttcgttttaacggacgggttaacaacgttagtcgaaacgttacgttccggttacggacgggttacgtaacgggggtccgggggaacctaaccgggggtcccttaaccccgggttgggttaacccttccgg

SEQ ID NO: 314072 - DNA, 663 bp, Homo sapiens
  misc_feature: GZ8MTXP01BYKDN.22.41.D08.1.454.CMB.2.raw
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcgtggggcctcagtgaaggtctcctgcaaggcttctggttacacgtttaggagtctatggtatcggtttgggtgcgacacggcccctggacaacggcctgagtggatgggatggatcgaacccttagtaaagggaaactacaaactatgacaaggagaggccctaccgaggggcaaggagtaccaaccaagtacgaacccgcacgaaccaccgaaacccaaacgacccaacgacgacctacgagtagggaacgttgaaggtacgtcgtagacgaccgttagacggggaaccgtacggggtaccttaagttaacgttacgcggtcgaacgggacggtacggggttcgttttaccggtagggtaacgtaacgttaggtgttaacgttaacgtccgttacggacggcgtaaccgggtgggggaacccgtaggggccttaccccgttgggttcctaaccgg

SEQ ID NO: 314073 - DNA, 653 bp, Homo sapiens
  misc_feature: GZ8MTXP01CIITM.22.41.D08.1.454.CMB.2.raw
  modified_base (242)..(242): a, c, t, g, unknown or other
  misc_feature (242)..(242): n is a, c, g, or t
  modified_base (412)..(412): a, c, t, g, unknown or other
  misc_feature (412)..(412): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcattccttttcttggtggcagcagcaactggtgcccgctctcaggttcaattggtgcagtctggacctgaggtgaagagccgtggggcctcagtgaaggtctcctgcaggcttntggttacacggtttaggagtctattggtattcggtttgggtcgcgacgacggccccgtggaccaacggcctgaggtggagtgggatggatacgaacccttacgtaagggaaacaacgaaactgtagacaggagacggccctcgaggcagacgtacacaagtcgacccganacgaccaccaaccgaacgaccaacacgacctacgagtagggtagttacgggagtacgtcgtagacgaccgtacggaaccggacgtaccgggtacccgttaatacgttacgtggaccggacggtagggtcgggttccgtttacgtaccgggtgtaacgttacgtaggttagttaacttcgacgacggttccgtcgggtcggggcccggacgggtcccgttacccggttcggttcgttaaccg

SEQ ID NO: 314074 - DNA, 595 bp, Homo sapiens
  misc_feature: GZ8MTXP01DRUT2.22.41.D08.1.454.CMB.2.raw
  modified_base (293)..(293): a, c, t, g, unknown or other
  misc_feature (293)..(293): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
  modified_base (507)..(507): a, c, t, g, unknown or other
  misc_feature (507)..(507): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
  modified_base (555)..(555): a, c, t, g, unknown or other
  misc_feature (555)..(555): n is a, c, g, or t
  modified_base (562)..(562): a, c, t, g, unknown or other
  misc_feature (562)..(562): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcattccttttcttggtggcagcagcaactggtgcccgctctcaggttcaattggtgcagtctggacctgaggtgaagagccgtggggcctcgagtgaaggtctcctgcaaggtcttcgtggttactacggttttaggagtctagttggtagttcggtttagggtncgacgacggccccctgggaaccaacggctagagtggatgggatggatacgaacccttagaaaggaacacaaacgtgtgacagagagcccacggaggcagacgtacaacctgcgaccgactacgacacgaaccaaacgaccanacgtcaacagnggtagttggaggtactacgagaacgcgtacgaacggacgacgggtaccttaatagttacgngaccgtggaggtagtcgtttagcggtntaacgngtagntagtcttagnggttacnggtcgggccacgggcttaccggtgttctaaccg

SEQ ID NO: 314075 - DNA, 625 bp, Homo sapiens
  misc_feature: GZ8MTXP01EV3WW.22.41.D08.1.454.CMB.2.raw
  modified_base (218)..(218): a, c, t, g, unknown or other
  misc_feature (218)..(218): n is a, c, g, or t
  modified_base (278)..(278): a, c, t, g, unknown or other
  misc_feature (278)..(278): n is a, c, g, or t
  modified_base (611)..(611): a, c, t, g, unknown or other
  misc_feature (611)..(611): n is a, c, g, or t
  modified_base (620)..(620): a, c, t, g, unknown or other
  misc_feature (620)..(620): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagccgtggggcctnagtgagtctcctgcaggtcttcgtgttacacgtttaggatctagtggtattcggtttggngcgtacgacggccctggacacggctgagtggagtggatggatacgaaccttagaaacgggaacacaatgagacgagagacgccctaccggaggcgacgacgtaaccacgcgtacgacccgacacgacccgaaaccaaaccgaaccgaacccaacgtaccgtactaacagtgggtaacggttaggacggagttcgacgacgaaccgtaggaaccggacgtaacggggtccttaaagtacgttacgacggccgaggtacggtacgggttcgtttacgtacgggtaataacgttagtagttacgtactcgcgagccgtgggcggaacgcggtcccncgtcggttntccgg

SEQ ID NO: 314076 - DNA, 547 bp, Homo sapiens
  misc_feature: GZ8MTXP01D3S37.22.41.D08.1.454.CMB.2.raw
  modified_base (329)..(329): a, c, t, g, unknown or other
  misc_feature (329)..(329): n is a, c, g, or t
  modified_base (349)..(349): a, c, t, g, unknown or other
  misc_feature (349)..(349): n is a, c, g, or t
  modified_base (381)..(381): a, c, t, g, unknown or other
  misc_feature (381)..(381): n is a, c, g, or t
  modified_base (490)..(490): a, c, t, g, unknown or other
  misc_feature (490)..(490): n is a, c, g, or t
  modified_base (510)..(510): a, c, t, g, unknown or other
  misc_feature (510)..(510): n is a, c, g, or t
tcagacatacgcgtcacgaccggtgctcgatttagtcacgcgagaaagggaaagggacccaaaaccacacccctccttgggagaatcccctagatcacagctcctcaccatggactggacctggagcatccttttcttggtggcagcagcaactggtgcccgctctcaggttcaattggtgcagtctggacctgaggtgaagagcctggggcctcagtgaagtctcctgcaaggcttctggttacacgtttaggagctatggtatcggtttgggtgcgacaggcccctgggacaacggcctgagtggatgggatggatcgaaccccttntaaagggaaacacaaaactntagcagagaggcctccgagggcagagtacacntgaccgcagacacaccaaacgacacagcctacatggaagttgaggagtctgagacctagacggacacggggcctatatactgcgtcgagtagggtctttacgacgggtnacttgtgaagtatcgttcgnggcaacggtggggccaggggcacccgtggttctaacg

SEQ ID NO: 314077 - DNA, 624 bp, Homo sapiens
  misc_feature: GZ8MTXP01C8UTW.22.41.D08.1.454.CMB.2.raw
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (517)..(517): a, c, t, g, unknown or other
  misc_feature (517)..(517): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctctgcaggtcttntgttacacgtttagganctatgtattcggttgggtgcgacacggcccgtggacaacggccgtgaggtggatggggatggatacgtaacccctttagaaacgggaaacaactaaactagtacgacaaggtagacggccctccgaggggcacggaagtacccaaccaagtcgacccgacaacgacaaccaccgaaaccgaccaacacgacctaacgagtacggaagttagaagtcggctagacgactagacggaacgacggtacctaatacttacgngcgacgtagtacggttgttaccgacggtaagtattagtggacgttacgtcgacgttcggacgaaccgggtcgggccgaagggtcccaccggtcggttaactaaccgg

SEQ ID NO: 314078 - DNA, 801 bp, Homo sapiens
  misc_feature: GZ8MTXP01BKOV4.22.41.D08.1.454.CMB.2.raw
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcgagtgaaggtctcctgcaaggtctttcgtggttactacggttttaggagtctagttggtattcggtttgggtgcgacgacgggcccctagggaccaacggcctggaggtggagtgggatggatacggaacccttagaaagggaaaccaacgtaaaactgtagacgaagaaggacggacccctaccggacggggacgaaggtaccggtaaaccctaacccgaagtacccgggaacccgacgaaacggaaacccaaacccgaaaccccgaaaaacccggaaccccaaacgtaaaccggacccccgttaaagtaacgttaacgggggtaaggtttagggaaacggggtacggtacgttacgggaaacgtacccgttacggaaaccggggtaaaccgtaacccgggggtaaacccttaggtttaaaccgttccggttagggccgaccgggtaacggtacgggggtttacctttacccgggtaggggtaaccctaagttaggtccggttaagttaacggttccaggttacggttcgaacggttcgggggaacctacgggggccgttacccgtgggttccgtaaccgg

SEQ ID NO: 314079 - DNA, 786 bp, Homo sapiens
  misc_feature: GZ8MTXP01EY4HP.22.41.D08.1.454.CMB.2.raw
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcattccttttcttggtggcagcagcaactggtgcccgctctcaggttcaattggtgcagtctggacctgaggtgaagagcgtgggctnagtgagtctctgacaggtcttgtaggttactacggtttaggngtacttagttggtagttcggtttgggtcgcgtacgcggtccccgtaggaacgaacggtccgtaggtaggtggtacggtagggagttagggtacgttacggtaaaccccgtttaagggtaaaaccgggaaaactaaaccgtaaaagtagtacggacgtaagggtaacggacggttaccccgaccgggagggacgtaacggaccgtaaaccaacgtaacggtaccgaaccggacaacgtaacccaacgaacccgaaacgtacccaacacggtacctagagtacgggtagttacggaagtcttacgagaaccgacgtacggaaccggtacggtaccgggtacttataacgttacgcggtacggtacggggtaggtacccgggggtttactttaacccgggtgggtaaccgttaaacggtttaggaccgggtttaaacgttccgttcggacggggttaacggttcccgaacgggggtcggaacccggttaacgggggcccttaaacccgggtttcgggttaacctccccggg

SEQ ID NO: 314080 - DNA, 590 bp, Homo sapiens
  misc_feature: GZ8MTXP01AQD5N.22.41.D08.1.454.CMB.2.raw
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
  modified_base (447)..(447): a, c, t, g, unknown or other
  misc_feature (447)..(447): n is a, c, g, or t
  modified_base (536)..(536): a, c, t, g, unknown or other
  misc_feature (536)..(536): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagccgtgggcctcagtgaaggtctcctgcaaggcttctggttacacggtttaggagctatggtattcggtttgggtgcgacgacggcccctggactaacggcctggagtggagtgggatggatacgaaccccttagtaaagggaaacacaaactagtgacagagacggcctccgagggcagagtacaccngcgaccnagacacacacgaccanacgctacatggagtgaggntcagagtaccngacgggacgacggtccgtaatacttacgcgaccgagacggtaggtccgtttacgacggtgtaaccttgtcgttagttacgtccttcggnggaccgtaacggtcggggaaccacgggggccttacccgtgggttaacctaaccg

SEQ ID NO: 314081 - DNA, 533 bp, Homo sapiens
  misc_feature: GZ8MTXP02JVX9Q.22.41.D08.1.454.CMB.2.raw
  modified_base (329)..(329): a, c, t, g, unknown or other
  misc_feature (329)..(329): n is a, c, g, or t
  modified_base (378)..(378): a, c, t, g, unknown or other
  misc_feature (378)..(378): n is a, c, g, or t
  modified_base (490)..(490): a, c, t, g, unknown or other
  misc_feature (490)..(490): n is a, c, g, or t
tcagacatacgcgtcacgaccggtgctcgatttagtcacgcgagaaagggaaaggggacccaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcggtttgggtgcgacaggcccctggacaacggcctgagtggatgggatggatgaacccttntaagggaaacacaaactatgcagagaggcctccgagggcagagtcaccntcgaccgcagaccacaccaacgacccacagccctacatcgagttgaggagtctgacgacctgacgacacggccgtatattactgcgcgagagggcgtttcgaggtgacttangagtactctcagtcaacgtggggccagggcacccgtggctacg

SEQ ID NO: 314082 - DNA, 526 bp, Homo sapiens
  misc_feature: GZ8MTXP02JCN6U.22.41.D08.1.454.CMB.2.raw
  modified_base (328)..(328): a, c, t, g, unknown or other
  misc_feature (328)..(328): n is a, c, g, or t
  modified_base (375)..(375): a, c, t, g, unknown or other
  misc_feature (375)..(375): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgttgggtgcgacaggcccctggacaacggcctgagtggatgggatggatgaacccttntaagggaaacacaaactatgcagagaggctccagggcagagtcaccntgaccgcagacacaccaacgaccacagcctacatggattgaggagtctgagacctgacgacacggccgtatatactgcgcgagagggcgtttcacggtgactatggagtatctcaggcaacgtgggggccaggggcacccgtggtctaacg

SEQ ID NO: 314083 - DNA, 652 bp, Homo sapiens
  misc_feature: GZ8MTXP02GI6J5.22.41.D08.1.454.CMB.2.raw
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcctggggcctcagtgaaggtctcctgcaaggcttctggttacacgtttaggagctatggtatcgtttgggtgcgacaggcccctggaccaacggcctgagtggatgggatggatgaacccttgtaaagggaaacacaaactatgacagagaggcctaccgaggcagagtcacntcgaccgnagaccacaccaaacgacccaacacgaccctaacagtagggtaacgttggaagggtacgttaccgtaggaacgtaaccgtaggaaacccggaccgtaaccggggtacccgttaaagttacgtttaaccgcgggtaccggacggtagggtacgggggttccgttttacggtaaccgggtagtaaccgttagtacggttaacggtattccgtaccgaggaccgtaacggttcggggaccgacggggccctaacccggtggtacctacg

SEQ ID NO: 314084 - DNA, 610 bp, Homo sapiens
  misc_feature: GZ8MTXP02IVOFI.22.41.D08.1.454.CMB.2.raw
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcggttgggtgcgacaggcccctggacaacggcctgagtggatgggatggatgaacccttgaaagggaaacacaaactatgacagagaggcctaccgagggcagagtcacagtcgaccgcagaccaacgaacccaaacgaccacagtccctaacagtacggagttgaaggtactacgtgaaacgaacccgttaaacggaccgtaaccggtaccgtaacttaacgtttaaccgcggccggacgaacgggaacgggttccgtttacgacggtgtaactagtaggtagtactcgtcgaacggcacggtcggggaccacggggcctaccgtgggtaccagttcccg

SEQ ID NO: 314085 - DNA, 543 bp, Homo sapiens
  misc_feature: GZ8MTXP02F6EVT.22.41.D08.1.454.CMB.2.raw
  modified_base (377)..(377): a, c, t, g, unknown or other
  misc_feature (377)..(377): n is a, c, g, or t
  modified_base (403)..(403): a, c, t, g, unknown or other
  misc_feature (403)..(403): n is a, c, g, or t
  modified_base (439)..(439): a, c, t, g, unknown or other
  misc_feature (439)..(439): n is a, c, g, or t
tcagacatacgcgtcacgaccggtgctcgatttagtcacgcgagaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaacgggccctcgctacttaatgaagattggcctatttggcagccaccacgaaggggtcggatccctgatcgcttcgtcgggctccgagctcgtcggggccagcgctacctcaccntcctccacgccctccagtctagaagntggagctgaactattactgtacagacagtgggacgngtggcgtcgtgggctggtcggcggacgggacagcgtcgaccgtcgaggtccacgcccaaggcctcgcccccgtggctaccgtcgtcgtccccgcctcctcaccg

SEQ ID NO: 314086 - DNA, 569 bp, Homo sapiens
  misc_feature: GZ8MTXP02IQOZG.22.41.D08.1.454.CMB.2.raw
  modified_base (384)..(384): a, c, t, g, unknown or other
  misc_feature (384)..(384): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgcaaggcttctggttacacgtttaggagctatggtatcggtttgggtgcgacaggcccctggacaacggcctgagtggatgggatggatcgaacccttgtaaagggaaacacgaaactatagacagagaggcctaccgaggcagagtcacntgaccgcagaccacaaccaacgaccacacgcctacatggagttggaaggtagtcgtagacgacctagacgacgacggaccgtatactacgtgacgcgaggagggtcgtttacgacggttcgacgttatagtagtactcgtcgaggcgaacggtcggggaccgacgggcctacccgtggtactacg

SEQ ID NO: 314087 - DNA, 588 bp, Homo sapiens
  misc_feature: GZ8MTXP02IX18P.22.41.D08.1.454.CMB.2.raw
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (471)..(471): a, c, t, g, unknown or other
  misc_feature (471)..(471): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatcctttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacaggcccctggacaacggcctggagtggatgggatggatgaaccccttgtaagggaaacacaaactatgcagagaggcctcgaggcagagtcacntgacncagacacaccaacgaccacacgacctacatcggagttggaaggagtcgtagaacgaccctggaccgacgacggccgtaagtacttaccgngacgacggaggtacgggtcgtttacgtacgggtactacgttagtaggtacgttactccgtacgacggaccgtaacgggtcggggaccgacggggccctacccggttcggtaccgtcg

SEQ ID NO: 314088 - DNA, 631 bp, Homo sapiens
  misc_feature: GZ8MTXP02F5EDR.22.41.D08.1.454.CMB.2.raw
  modified_base (392)..(392): a, c, t, g, unknown or other
  misc_feature (392)..(392): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacacggcccctggaccaacggcctggagtggatgggatggatcgaacccttgtaaacgggaaacaacaaactagtgacagagaggccctaccgagggacaggactccaccngtcgaccgacagaccacaccaaacgacccacacgcctaacagtaggtagttggaaggtacgtcgtacggacgaccgtggaaccggaccgaccggccgttaattacgttaccgtggaccgacgggtaaggacggggttaccgtttacgtacgggtcgtaacgttagtaggtacgtactccgtacgacggtaccgtaacggtacggggaccgtacggggaccctacccggtcggtcgtacg

SEQ ID NO: 314089 - DNA, 557 bp, Homo sapiens
  misc_feature: GZ8MTXP02JM36O.22.41.D08.1.454.CMB.2.raw
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (378)..(378): a, c, t, g, unknown or other
  misc_feature (378)..(378): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacaggcccctggacaacggcctgagtggatgggatggatgaacccttntaagggaaacacaaactntgcagagaggcctccgagggcagagtcaccntgacgcagacacaccaacgaccacacgcctacatacgaagttgaggtagtctagagaccgtgaacgacaccggccgtatattacgtgacgtcgaggtcgggtcgtttcgacggtgacttagtcggagttactctcgaaggcaacggtcggggcccacggggccacccggtggtactacg

SEQ ID NO: 314090 - DNA, 618 bp, Homo sapiens
  misc_feature: GZ8MTXP02JFCIB.22.41.D08.1.454.CMB.2.raw
  modified_base (375)..(375): a, c, t, g, unknown or other
  misc_feature (375)..(375): n is a, c, g, or t
  modified_base (491)..(491): a, c, t, g, unknown or other
  misc_feature (491)..(491): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagtctatggtatcggtttgggtgcgacaggcccctggacacggcctgagtggatggatggatgaacccttgtaagggaacacaaactatgacagagagcctcgagggcagagtcacntgacgcagacacaaccaacgaccacacgaccctaacgatgggagttggaaggtaggttaccaggaacgacccgttggaaccgaacgaccggggtacccttaagtaacgtttaccgnggaccggaggacggtacggggttccgtttacgtaacgggtacgtaacgttagtacggaacgttctccgtacgacggaccgtaacgggtcggggaccgcggggtaccctacccggttacggacctacg

SEQ ID NO: 314091 - DNA, 700 bp, Homo sapiens
  misc_feature: GZ8MTXP02HTI35.22.41.D08.1.454.CMB.2.raw
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
tcagacatacgcgtcacgaccggtgctcgatttagtcacgcgagaaagggaaagggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagctggggcctnagtgaggtctctgcaaggcttntgttacagttaggnctatggtatcggttggtncgacaggcccctggacaacggcctgagtggatgggatggatcgaacccttgtaaagggaaacacaaaactatgacagagacggccctaccgaggggcaaggacgtaccaccagtacgacccgcacgaaccaccgaaaccaaaccgacccaaacgacgacctaacagttcgggtagttacggaggtagtccgtaggaacgacccgttaggaccggtaacgtaaccggggtaccttaagtaaccgtttacgcgggaccggtaaccggggaagggttaacgggggtccgtttttaaccgaacggggtttacgtaaaccgtttaagtacggtaagttaaacgttcccgttaacggaacgggtacccgtaaacgggttccgggggaccccgtaaacgggggcccttaaacccccggttggggtttaccctaaccgg

SEQ ID NO: 314092 - DNA, 550 bp, Homo sapiens
  misc_feature: GZ8MTXP02G06WY.22.41.D08.1.454.CMB.2.raw
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgttgggtgcgacaggcccctggacaacggcctgagtggatgggatggatgaacccttgtaaagggaaacacaaactatgacagagagccctcgaggggcagagtcaccngtgaccgnagacacaccaaacgaccacacgcctacatgagttggaggagtcagacgactgaacgacacggccgtatatactgcgacgagagggcgtttcgacggtgacgtatacgtagtactcgtacgaggtcaacggtcggggaccgacggggccgacccgtggactacg

SEQ ID NO: 314093 - DNA, 595 bp, Homo sapiens
  misc_feature: GZ8MTXP02GY6SO.22.41.D08.1.454.CMB.2.raw
  modified_base (286)..(286): a, c, t, g, unknown or other
  misc_feature (286)..(286): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
  modified_base (496)..(496): a, c, t, g, unknown or other
  misc_feature (496)..(496): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctctaggttcaattggtgtcagtctggacctgaggtgaagagccgtgggctcagtgaaggtctcctgcaagggcttcgtggttacacgtttaggagctatggtatcggttgggtgcgtanaggcccctggacaacggcctgagtggatggggatcggatcgaaccccttagtaaaaggggaaaacacgaaaactagtgcaagaggagcctaccgagggcaggagtcaacntcgaccgnaacgacacaccgaaacgaccanacgtacccaanatacggagttgaaggtacgtcagggaacaccgtgacgaccagggccttaagattaccgngacggacgaggacggtcgttacgacggtacacttagtacgtattacgtcgtacgacggacgtaacgggtcgggaccgacggccctaccggtcgtacacg

SEQ ID NO: 314094 - DNA, 559 bp, Homo sapiens
  misc_feature: GZ8MTXP02JQQB5.22.41.D08.1.454.CMB.2.raw
  modified_base (377)..(378): a, c, t, g, unknown or other
  misc_feature (377)..(378): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgttggtgcgacaggcccctggacaacggcctggagtggatgggatggatgaacccttgtaaagggaacacaaactatgacagagaggccctcgagggcagagtcacnncgacgcagacacgaccaacgaccacacgacctacagtgagttgaggagtcgtgacgactgacgacgacggccgtatatacgtgacgacgaggagggtcgtttcgacggtgacttagtacggtagtactcgtacgaggtaccgaacggtcggggaccgacggggaccacccgtggtactacg

SEQ ID NO: 314095 - DNA, 581 bp, Homo sapiens
  misc_feature: GZ8MTXP02GLSI9.22.41.D08.1.454.CMB.2.raw
  modified_base (468)..(468): a, c, t, g, unknown or other
  misc_feature (468)..(468): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcctggggcctcagtgaaggtctcctgcaaggcttctggttacacgtttaggagctatggtatcgttgggtgcgacaggcccctggacaacggcctgagtggatgggatggatggaacccttcgtaagggaaacacgaaactgtagacagagaggccaccgagggcaggagtccacatcgaccgcagaccacaccaacgaccacacgcctacatggagttgaggagtcagagacctgaccgacgaccggcgtaatacttacgngccggagaaggacgggtccgtttacgtaaccgggttcaacgttagtacgtagttactacgtacgtacggacgaacgggtcgggaccgtacgggacctaccggtcggtactacg

SEQ ID NO: 314096 - DNA, 740 bp, Homo sapiens
  misc_feature: GZ8MTXP02HGOVS.22.41.D08.1.454.CMB.2.raw
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagccgtggggcctcagtgaaggtctcctgcaaggtcttcgtggttacacggtttaggagtctagtggttattcggtttgggtgcgacgacggcccctggaccaacggcctggagtggatgggatggatcgaacccttgtaaagggaaacacgtaaactagtagacgagaggaggccctaccgagggcaaggacgtaccaaccgtgtaccggaacccgacgaacgaaccaaacccgaaacccgaaaaccggaacccaaccgaacgaccctaacgagttacggggtagttaggaacgggtagtaccgtagaacggtaacccgtaggaaacccggaaccgtaaccgggtacccgttaaagttaacgtttaaccggcggaccggacgggtaacgggtaacgggggtttccgttttaccggtaacgggttacgaaccgtttaaggtacggtaaaggttacttaccgtaccggtaacgggaccgtaaccggggttcgggggacccgtacgggggaccctacccggttaggtacccttaccgg

SEQ ID NO: 314097 - DNA, 601 bp, Homo sapiens
  misc_feature: GZ8MTXP02HC8T0.22.41.D08.1.454.CMB.2.raw
  modified_base (388)..(388): a, c, t, g, unknown or other
  misc_feature (388)..(388): n is a, c, g, or t
  modified_base (410)..(410): a, c, t, g, unknown or other
  misc_feature (410)..(410): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggtttaattggtgcagtctggacctgaggtgaagaagcctggggcctcagtgaaggtctcctgcaaggcttctggttacacgtttaggagctatggtatcgtttgggtgcgacaggcccctggacaacggcctgagtggagtgggatggatgaaccctgtaaaggaacacaaactatgcagagaggctcccgaggcagacgtacaccgatcgaccganacgacacaaccaaacgacccanacgacctacagtggagttagaggtgtacgtagacgacctaggaccgaacgaccgggtacgtaacttacgtaactcggacgacggtagacggggttccgtttacgacggtaggtaaccttagtcgtaacgtattcgcgaacggtcgaacggtggggaccgacggggtaccacccggtttgccgtaatcccgg

SEQ ID NO: 314098 - DNA, 555 bp, Homo sapiens
  misc_feature: GZ8MTXP02FJR46.22.41.D08.1.454.CMB.2.raw
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
  modified_base (463)..(463): a, c, t, g, unknown or other
  misc_feature (463)..(463): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacaggcccctggacaacggcctgagtggatgggatggatgaacccttctaagggaaacacaaactatagcagagaggcctccgaggggcagagtcaccntcgaccnacgacacaccaacgaccacagcctacatggagtgaggagtctagagacctgacgacgacggcctaatattactggngacggagagggcgtttcgacggtgacttagtcgtagttactcgtacgaggccgaacggtcggggccacgggggccacccgtgggtacctacg

SEQ ID NO: 314099 - DNA, 598 bp, Homo sapiens
  misc_feature: GZ8MTXP02GP38B.22.41.D08.1.454.CMB.2.raw
  modified_base (481)..(481): a, c, t, g, unknown or other
  misc_feature (481)..(481): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttggtgcgacaggcacgtggaccaacggcctgagtggatgggatggatgaaccccttgtaaagggaaaacacaaacgtatgacagagacgctccgagggcaggatcaccgatcgaccgcacgacaccgaccaaacgacctaacacgacctacagtacggagttgacgggagtctaggacgactggacgacgacggccgtatacttacgngtcgacggagtagggtcgtttacgaaccgggttgaaaccttaggttagaaggttacctacgtcgaacgggcgtaccggtacgggggacccgagggggtcccaacccggttggtcccg

SEQ ID NO: 314100 - DNA, 655 bp, Homo sapiens
  misc_feature: GZ8MTXP02H1W7H.22.41.D08.1.454.CMB.2.raw
  modified_base (410)..(410): a, c, t, g, unknown or other
  misc_feature (410)..(410): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatcctttttcttggtggcagcagcaactggtgcccgctctcaggttcaattggtgcagtctggactgaggtgaagagcctgggcctcagtgaaggtctcctgcaaggctttcgtggttacacggttttaggagtctagtggtatcggtttgggtgcgacgaggcccctggacacggctgagtggagtgggatggatcggtaacccgttcgtaaaagggaaaaccacgtaaaactagtagacgagaaggacggcctaccgaagggcgagaacggtaccaccngtacgacgacacgaaccaaccaacccaaacgacccaactacgaccctaacgagtacgggtagttaggacggtaagtacgttagaaaccgaccgtaaaccgacgaccggtacctaatacgtacgtgcggacgaggtacgggtcgtttacgtacggtacgtacgttagtacggaagttacacgttacgacgggtaccacggtcgggggaccgtacggggaccctaccggttcggtacctacgtcccg

SEQ ID NO: 314101 - DNA, 612 bp, Homo sapiens
  misc_feature: GZ8MTXP02FUWD2.22.41.D08.1.454.CMB.2.raw
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgcaaggcttctggttacacgtttaggagtctagtggtattcggtttggggtgcgtacgacggcccctggacaacggcctggagtggatgggatggatcgaacccttgaaagggaacaacaaactatgacagagagcctccgagggacagacgtaccaacngtcgaccganaacgacaacaaccaaacgaccacacgaccctaacagtaggagtggaaggtacgtcgtagacgaccgtaggaaccgaacgaccggaccttaagtattaccgtgacggaggaaggtacgggtacgtttacgaacggtagtacgtatacggaagttactcgtacgaggcgaacgggtcgggaccgacgggacctaccggttcggtacctacg

SEQ ID NO: 314102 - DNA, 606 bp, Homo sapiens
  misc_feature: GZ8MTXP02ITRFH.22.41.D08.1.454.CMB.2.raw
  modified_base (381)..(381): a, c, t, g, unknown or other
  misc_feature (381)..(381): n is a, c, g, or t
  modified_base (414)..(414): a, c, t, g, unknown or other
  misc_feature (414)..(414): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcggtttgggtgcgacaggcccctggacaacggcctgagtggatgggatggatgaacccttgtaaagggaaacacaaactatgacagagaggcctccgagggcagagtcaccntcgaccgcagacacaccaacgaccacagcctanagtggagttgaggagtcgtgaacgaccgtgaaccggacgaccgggtaccgtagttaacgttacgtcggacgcgggaaggtacggggtcgtttcgtaacgggtcgtacgttagtgtaagttaacttcgtacggtacggaccgtaacggtcgggggacccgtacgggggcctaccccggttggtaccgtaccgg

SEQ ID NO: 314103 - DNA, 632 bp, Homo sapiens
  misc_feature: GZ8MTXP02ITYNS.22.41.D08.1.454.CMB.2.raw
  modified_base (218)..(218): a, c, t, g, unknown or other
  misc_feature (218)..(218): n is a, c, g, or t
  modified_base (282)..(282): a, c, t, g, unknown or other
  misc_feature (282)..(282): n is a, c, g, or t
  modified_base (307)..(307): a, c, t, g, unknown or other
  misc_feature (307)..(307): n is a, c, g, or t
  modified_base (353)..(353): a, c, t, g, unknown or other
  misc_feature (353)..(353): n is a, c, g, or t
  modified_base (401)..(401): a, c, t, g, unknown or other
  misc_feature (401)..(401): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagccgtggggcctnagtgaaggtctcctgcaaggtcttcgtggttacacgtttaggagtctatggtatcggttgggtncgacaggcccctggacacggcctgngtggatgggatggatcgtaacccttgtaaagggaacacgtaaactntgacagagacgcctaccgaggacagacgtaccaactgtacgacccganacgaaccacaacccgaaacgacccaacacgacctacgagtacggagttacggagtagtctagacgacgtacgacgacgacggtacctataacgtcgtgacgtaggacggtacgggtacgtttcggaacggttacggtacgtttaaggtacggtacgttaacgttccgtacgtaggaccgtaacgggtaaccgggaccggacggggtacctaacccggtcgggtactaccgg

SEQ ID NO: 314104 - DNA, 681 bp, Homo sapiens
  misc_feature: GZ8MTXP02JRUTI.22.41.D08.1.454.CMB.2.raw
  modified_base (510)..(510): a, c, t, g, unknown or other
  misc_feature (510)..(510): n is a, c, g, or t
tcagacatacgcgtcacgaccggtgctcgatttagtcacgcgagaaagggaaagggacccaaaaccacaccctccttgggagaatccctagatcacagctcctcaccatggactggacctggagcattccttttcttggtggcagcagcaactggtgcccgctctcaggttcaattggtgcagtctggacctgaggtgaagaagcctggggcctcagtgaaggtctcctgcaaggtcttctggttaacacgtttaggagtctagtggtattcggtttggggtgcgacgacggcccctggaccaacggcctggagtggagtggatggatcgaacccttagtaaagggaaacaacgaaactatgacagagagcctccgagggcagacgtcaccatcgaccgcacgacaacacccaaacgaccaacacgacctacacgtggagttgaggtagtcgtagaacgtaaccggtacgaacggaccacggggtacccgttaagttaacgtttaaccgngggaccggtacgggaacgggtaacgggggttccggtttttaacgtaccggggttacggtaaccgttagttaggtaaacggttaacttaccgttacggtacgggaccgtaaccgggttacgggggacccggtaacgggggaccctaccccggttaggggttacctacccggg

SEQ ID NO: 314105 - DNA, 570 bp, Homo sapiens
  misc_feature: GZ8MTXP02G94LB.22.41.D08.1.454.CMB.2.raw
  modified_base (353)..(353): a, c, t, g, unknown or other
  misc_feature (353)..(353): n is a, c, g, or t
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (438)..(438): a, c, t, g, unknown or other
  misc_feature (438)..(438): n is a, c, g, or t
  modified_base (468)..(468): a, c, t, g, unknown or other
  misc_feature (468)..(468): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagccgtggggcctcagtgaaggtctcctgcaaggcttcgtggttacacgtttaggagtctatggtatcggttgggtgcgacaggcccctgggaccaacggcctgagtggatgggatggatgaaacccttgtaaaggaacaacgaaactngacagagagcctcgagggctaggatcaccngtcgacgnagacacaccaacgaccanacgtccanatgagtgaggatcagacaccngaacgacgacgggttacctataacttacgnggacgagaggtacggtcgttacgacggtactacgttagacggtacgtactcgtacgacgacgaacggtcgggaccggacggaccgtaccgtacgtacgtacg

SEQ ID NO: 314106 - DNA, 574 bp, Homo sapiens
  misc_feature: GZ8MTXP02GXA2I.22.41.D08.1.454.CMB.2.raw
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcggtttgggtgcgacacggcccctggacaacggcctggagtggagtgggatggatcgtaacccttgtaaagggaaacactaaactgtgacagagaggccctcgaggcagacgtcacntcgaccncacgacacaccaacgaccacacgcacgatggagtgagagtcgagacgactgacgacgacggtccgtagtacttacgtcgacggcgaggtacgggttcgttacgtaccgggtgactagttcgagtactcgacgtacggcgtaacggtcggggaccgacggggacctacccggtggtactacg

SEQ ID NO: 314107 - DNA, 663 bp, Homo sapiens
  misc_feature: GZ8MTXP02H9EYU.22.41.D08.1.454.CMB.2.raw
  modified_base (476)..(476): a, c, t, g, unknown or other
  misc_feature (476)..(476): n is a, c, g, or t
  modified_base (584)..(584): a, c, t, g, unknown or other
  misc_feature (584)..(584): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttactacggttaggagctagtggtatcggtttgggtgcgacgacggcccctggacaacggcctgagtggagtgggatggatacggtaaaccccgttgtaaaacggggaaactaaccgtaaaacgtagtagacaaggaggacggccctaccggagggacaaggtacgtaccaccagtcggaacccgcgaaacgaccaccgaaaccaaacccgacccaacgacgtaccctaanacgtggaagttggaaggtacgtcgtagaacgtaccgtaggaccgacggtaccggcgtaattacgttacgcgtcggacggtaggtacggggtcttttacggacgggttntacgttagtacgaacgttactccgacgtacggccgtaacgggtcgggaccgacgggccctaacccggtggtaacctcgg

SEQ ID NO: 314108 - DNA, 726 bp, Homo sapiens
  misc_feature: GZ8MTXP02JWGYL.22.41.D08.1.454.CMB.2.raw
  modified_base (217)..(217): a, c, t, g, unknown or other
  misc_feature (217)..(217): n is a, c, g, or t
  modified_base (281)..(281): a, c, t, g, unknown or other
  misc_feature (281)..(281): n is a, c, g, or t
  modified_base (392)..(392): a, c, t, g, unknown or other
  misc_feature (392)..(392): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcctggggcctnagtgaaggtctcctgcaaggcttctggttacacggtttaggagtctagtggtatcggtttgggngcgacaggcccctggacaacggcctggagtggatgggatggatgaacccttagtaaagggaacacaaactagtagacgaagagaggcccgtacgagggcacgactcgacgngtacggaccgagacgaaccaccgaacccgaaaccgaccaaacgacgtaccctaaacgagtacggtaagttcggaagggtacgttacgtacggaacgtacccgtacggaaccggacgtaccggggtaccgttaacgtaacgtaaaccgttcgggaccgggacggacgggtaacgggggttccgttttaccgggtaaaccgggttggttaaacccgttacgggttacggtaaacggttaacgttccgtaaccggtacgggtaccggtaaccggggttccgggggaacccgtaaacgggggtcccctaaaccccggggttggtaaccgtttacccgg

SEQ ID NO: 314109 - DNA, 640 bp, Homo sapiens
  misc_feature: GZ8MTXP02JDJZR.22.41.D08.1.454.CMB.2.raw
  modified_base (389)..(389): a, c, t, g, unknown or other
  misc_feature (389)..(389): n is a, c, g, or t
  modified_base (416)..(416): a, c, t, g, unknown or other
  misc_feature (416)..(416): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttcgtggttacacgtttaggagtctatggtattcggtttgggtgcgacaggcccctggacgaaccggcctggagtggatgggatggatcgaacccttgtaaagggaaacacaaactatagacagagaggcctaccgaggcagagtccacntcgacgcacgacacaccaaacgaccanacgcctaacataggagttcgaaggagttcgtagacgtaccgtagaaccgacaccggggtaccttaagttaactttaacgcggtacggacggtaacggggcggggttacgtttacgtacgggttacgtaccgttaagttacggtaaagtttaacgtcgttaccggaaggtccgtaaggtccgggggaaccgacgggggtacctacccggtacggtacgttacccg

SEQ ID NO: 314110 - DNA, 618 bp, Homo sapiens
  misc_feature: GZ8MTXP02JTQT4.22.41.D08.1.454.CMB.2.raw
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
tcagacatacgcgtcacgaccggtgctcgatttagtcacgcgagaaagggaaagggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgcaaggcttcgtggttacacgtttaggagctagtggtatcggtttgggtgcgacacggcccctggaccaacggcctggagtggagtgggatggatcgaacccttagaaggaacacaaactatgacagagcgccctacgagggcagacgtacacntacgaccgnacgacacaccaacgaccacacgcacagtcggagtgaaggcgtcgtagacgaccgtacggacgaccgacggacccgtagttacgttaacgtggacggtacggaggtacggggtacgtttacgtacggtacgtacgttacgtaggtacggttactaccgtacgacggtaccgtaacgggtcgggggacccgacgggggtccctaccccggttggtaaccgtcccg

SEQ ID NO: 314111 - DNA, 728 bp, Homo sapiens
  misc_feature: GZ8MTXP02JL05L.22.41.D08.1.454.CMB.2.raw
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacggtttaggagctatggtatcggttgggtgcgacaggcccctggacaacggcctaggacgtggagtggggatggagtacgtaacccgttacgtaaaggggaaaaccaacgtaaaaccgtagtacggacgaagaggtacggccccgtaccgaggggacaagggagtccaaccgacgtacggaccgacgaacgaacaacccgaacccgaaaacccgacccaaacgaacccggacccttaaacgacgttacgggtaaggtttacgggaaggtaacgtcgtacgaacgtacccgaggaaccgacggaccggtacccgtaagttaacttaccgtcggaccgtacgggaacggtacggggttaccgtttcgtaaccgggttacggtaaccttaggtagtaacgttacgtaccgttaccgacggtacctaacggggttaccggggacccggacggggtaccgtaccccggtgggtacctaaccgg

SEQ ID NO: 314112 - DNA, 631 bp, Homo sapiens
  misc_feature: GZ8MTXP02JY20T.22.41.D08.1.454.CMB.2.raw
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (407)..(407): a, c, t, g, unknown or other
  misc_feature (407)..(407): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttagganctatggtatcgtttgggncgacaggcccctggacacggctgagtggatgggatggatgaacccttgaagggaacacaaactngacagagagcctcgagggcaggactcacntgaccgnagacacaccaaacgacctacacgacctanacgtgggagttgaggtacgtacgtagaacgaccgtaggaaccgacgacgggtacgtataacgttaccgcggacgaccggtaagggacgggttcgtttaccggaacgggtttcgaaaccgttaggtaggtaacgttacgttaccgacggtaaccggtaccgaaccgggttacgggggacccgaaccgggggtcccctaacccgggtttacggccgtttaacccgg

SEQ ID NO: 314113 - DNA, 706 bp, Homo sapiens
  misc_feature: GZ8MTXP02JNCE2.22.41.D08.1.454.CMB.2.raw
  modified_base (581)..(581): a, c, t, g, unknown or other
  misc_feature (581)..(581): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgccccgctctcaggttcaattggtgcagtctggacctgaggtgaagaagccgtggggcctcagtgaaggtctcctgcaaggtcttctggttacacggtttaggagtctagtggtattcggtttgggtgcgacgacggcccctaggaccaacggccgtgaggtggagtgggagtggatacgtaaaccccgttacgtaaaacggggaaaaccaaaccgaaaacgttagtaggaaccgtaaggaaacggacggaccccgtaccggaagggacaggacgtaccaacccagtaccgaccgacgaacgaacaacccgaacccaaacccgaacccacgaaccgaccctaacgagtacgggagttaggaaggtacgtacgtacgaacgtaccgacgaacgaccggaccggtaccgttaatacgttaccgnggaccggacggaacggtcgggttaccggttttacgaccggggttagaacgttgtacggtagtaacgtccgtacgaccggacgtaacggtcgggaccgacgggacctccggtacggtacgtacccg

SEQ ID NO: 314114 - DNA, 561 bp, Homo sapiens
  misc_feature: GZ8MTXP02I7LGY.22.41.D08.1.454.CMB.2.raw
  modified_base (218)..(218): a, c, t, g, unknown or other
  misc_feature (218)..(218): n is a, c, g, or t
  modified_base (368)..(368): a, c, t, g, unknown or other
  misc_feature (368)..(368): n is a, c, g, or t
  modified_base (389)..(390): a, c, t, g, unknown or other
  misc_feature (389)..(390): n is a, c, g, or t
  modified_base (416)..(416): a, c, t, g, unknown or other
  misc_feature (416)..(416): n is a, c, g, or t
  modified_base (442)..(442): a, c, t, g, unknown or other
  misc_feature (442)..(442): n is a, c, g, or t
  modified_base (498)..(498): a, c, t, g, unknown or other
  misc_feature (498)..(498): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcattccttttcttggtggcagcagcaactggtgcccgctctcaggttcaattggtgcagtctggacctgaggtgaagagccgtgggcctnagtgaaggtctcctgcaaggcttctggttactacggtttaggagctagtggtattcggtttggggtgcgacacggcccctggacaacggcctggagtggatgggatggatcgtaacccttgtaaacgggaaacacaaactatgacagagngcctacgagggcagagtcacnncgacgcagacacaaccaacgaaccanacgcctacgagtggagtgaggacgtnagacgtactcgaacgacgacgctatatcgtgcggagaggagggtcgttcgacggtnacttgacgagtactctacgaggccgaacggtcgggaccgaggggtcccaccggtcgactaccg

SEQ ID NO: 314115 - DNA, 584 bp, Homo sapiens
  misc_feature: GZ8MTXP02GKR4T.22.41.D08.1.454.CMB.2.raw
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
  modified_base (473)..(473): a, c, t, g, unknown or other
  misc_feature (473)..(473): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacaggcccctggaccaacggcctgagtggatgggatggatgaacccttagtaaagggaaacacaaactatagacagagaggcctccgagggcagagtccacntcgacgnagacaacaccaacgaccacacgcctacatggagttgaggacgtcgtagacgaccgtagaacgacgacggcgttaatacttacncggcgacggacggagggtcgtttacgacgggtagtacttagcggtaagtacttacgtacggacggtacgaacggtcggggaccgacggggccctacccgtaggttcctacg

SEQ ID NO: 314116 - DNA, 682 bp, Homo sapiens
  misc_feature: GZ8MTXP02GAZOS.22.41.D08.1.454.CMB.2.raw
  modified_base (422)..(422): a, c, t, g, unknown or other
  misc_feature (422)..(422): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagccgtgggcctcagtgaaggtctcctgcaaggtcttcgtggttacacggtttaggagtctagtggtattcggtttggggtgcgacgacggccccgtggaccaacggcctggagtggagtgggatggatacgaacccttagtaaagggaaaacacaaactagtacgacgagacggtacggcctaccgagggcaaggacgtaccaccagtcgaacccgngaacgaccaaccaaccgaaacgaccactacgacctaacagtgggtaacgtggaagggtagtcgtaggacgtaccgtaggaaccggtacgaacgggtccctaaagttaacgttaacgcggacggacggtacggggtagggttaccggtttacgtaccgggggttactaacgtttaggtacggtaacgttaacgtcgttacggacggttccgtaacggggtccggggacgtaccggggacctaccggtcggtaccttaccgg

SEQ ID NO: 314117 - DNA, 685 bp, Homo sapiens
  misc_feature: GZ8MTXP02F6DTS.22.41.D08.1.454.CMB.2.raw
  modified_base (284)..(284): a, c, t, g, unknown or other
  misc_feature (284)..(284): n is a, c, g, or t
  modified_base (528)..(528): a, c, t, g, unknown or other
  misc_feature (528)..(528): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcctggggcctcagtgaaggtctcctgcaaggtcttctggttacacggtttaggagtctagtggtattcggtttgggtncgacacggcccctaggacaacggcctggagtggatgggatggatgaacccttgaaaggaacacaaactatgacagagaggccctaccgagggcaggacgtaccaccgagtcgacccgacaaacgtaaccaaccaaacccgaaacgaacccaacgacgacccttaacaagtacgggaagttcggaaggtaagtcgtaggaacgaccctaggaaccgacgaccgggtaccgttaatactttaccgnggaccggacggaaggtacggggttaccgtttacgtaaccgggtagtaaccttaggtacggtaaacgttacgttaccgacgacggggttaccaaccggggttcgggggaacccccgaagggggtcccctaaccccggttaggggtacccttaaccggg

SEQ ID NO: 314118 - DNA, 738 bp, Homo sapiens
  misc_feature: GZ8MTXP02IVMDI.22.41.D08.1.454.CMB.2.raw
  modified_base (218)..(218): a, c, t, g, unknown or other
  misc_feature (218)..(218): n is a, c, g, or t
  modified_base (418)..(418): a, c, t, g, unknown or other
  misc_feature (418)..(418): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcattccttttcttggtggcagcagcaactggtgcccgctctcaggttcaattggtgcagtctggacctgaggtgaagagccgtgggcctnagtgagtctctgcagcttctggttactacgttaggagtctagtggttattcggtttggggtgcgacgacggtccccgtaggaccaaccggcctggaggtggagtggagtggatacgaacccgttagtaaacggaaacctaacgaaactagagacgaggaacggacggcccctaccggaggacgaggtaactccgaaccgnggtaccaaccgacgaacgaaccaaacccgaaaccaaaccgaacccacgaccgacctaacgagtaggtaaggttaggaacgtacgtcgacgaacgtaccgtacgaccgaaccggtacggtaccccgttaagttaaccgttaaccgtcggaacggtacggtaaacgggtacggggttccgtttaacggtacgggttaacgtaaccggtttagttaacggtaacggttaactttccggttaaccgacggtaccgtaacgggggttccggggtaacccgggaccggggtacccgtaacccggtttcggtttacccgttaaccgg

SEQ ID NO: 314119 - DNA, 721 bp, Homo sapiens
  misc_feature: GZ8MTXP02INMR1.22.41.D08.1.454.CMB.2.raw
  modified_base (166)..(166): a, c, t, g, unknown or other
  misc_feature (166)..(166): n is a, c, g, or t
  modified_base (219)..(219): a, c, t, g, unknown or other
  misc_feature (219)..(219): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcattccttttcttggtggcagcagcaactggtgcccgntctcaggttcaattggtgcagtctggacctgaggtgaagagccgtggggcctnagtgaaggtctctgcaaggtcttctggttactacgtttaggagtctagttggtattcggtttgggtgcgtacgacggccccgtaggaccgaacggcctggacgtggagtgggatgggatacgtaacccttgtaaaggaaactaacgaaactatgacgagagacgcctaccgagggacaggagtaccacagtcgaccgcaacgaccacgaaccaacgaccacgacgttacaacgatacgggtagttaggaaggtacgttaccgaggaaccgttaccgtaggtaacccgaacggtacccgggtacccgttaaagttaaccgtttaccgtacggacggttaccgggaaaggggtccggggtttaaccgtttacgggttaacgggtttaaccggaacgtttaaacgggtcgttaaagtaccgtttaaccgcggttaacggtaccgaacggggttcccgggacccgtaacggggtacccgtaccccgtttggggtaacccttaccgg

SEQ ID NO: 314120 - DNA, 565 bp, Homo sapiens
  misc_feature: GZ8MTXP02I53NR.22.41.D08.1.454.CMB.2.raw
  modified_base (257)..(257): a, c, t, g, unknown or other
  misc_feature (257)..(257): n is a, c, g, or t
  modified_base (283)..(283): a, c, t, g, unknown or other
  misc_feature (283)..(283): n is a, c, g, or t
  modified_base (346)..(346): a, c, t, g, unknown or other
  misc_feature (346)..(346): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
  modified_base (432)..(432): a, c, t, g, unknown or other
  misc_feature (432)..(432): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcctgggcctcagtgaaggtctcctgcaaggcttctggttacacgtttaggnctagtggtatcggtttgggtgcgacnggccctggacacggcctgagtggatgggatggatgaacccttcgtaaagggaaacacaaactntgacagagacgcctccgaggcaggacgtcacngtcgacncagacacaaccacgaccacacgactacatggattgaggtagtctagngaacctggaacgacgacggaccgtatactacgtgcgcgagtagggtcgttcgtacggtagacgtaatcggaagttactacgtacgacggcaacggtcgggggacccgtaggggacccacccggtggtctacgg

SEQ ID NO: 314121 - DNA, 705 bp, Homo sapiens
  misc_feature: GZ8MTXP02HO9P5.22.41.D08.1.454.CMB.2.raw
  modified_base (390)..(390): a, c, t, g, unknown or other
  misc_feature (390)..(390): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggtactacgttaggagctatggtatcgttggggtgcgacgacggcccctggacaacggcctgagtggatgggatggatcgaacccttgtaaagggaaacactaaaactatagacaagagaggcctaccgagggacagagtccaaccngtacgaccgacagaaccacgaaccaaacgacccaacacgcctaacagtaggtagtacggaggtagtcgtagaacgtaccgtacgaaacggaccgaacggtacccgttaagttaacgtttaccgaggaccgaccgggtaagggtaaccgggggtccgtttttaaccggaacggggttacggtaaaccctttagggtaacggttaagggttaaactttcccgtaccggaaacggggaccgttaaaccgggggtcgggggaaaccccgggtaccggggaccccgtttaacccccggtaaggggttcccttaacccggg

SEQ ID NO: 314122 - DNA, 702 bp, Homo sapiens
  misc_feature: GZ8MTXP02JP9X5.22.41.D08.1.454.CMB.2.raw
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctccgtgcaaggtcttcgtggttacacgtttaggagctagtggtatcggtttgggtgcgacacggcccctggacaacggcctggagtggagtgggatggatgaacccttagtaaacgggaaaacactaaactagtagacagagacggccgtaccgaggggcaggacgtaccgaaccgagtcggaacccgcgaaacgaacccaaccgaacccaaacccggaacccaaccgaaaccggacccttaacgaacgttaggggagtttacgggaagggtacgtacgtagaacgtacccgtaggaacgacggaccggaccggttataaagtttccgacggccggacggaacgggtagggtaccgtttacgtacggggtacgtaccgttagtacggtacggttaacgtccgtacggacggttacgtaaccgggttacgggggacccgtacgggggaccctaccccggttgggttaacctccgg

SEQ ID NO: 314123 - DNA, 689 bp, Homo sapiens
  misc_feature: GZ8MTXP02GZ666.22.41.D08.1.454.CMB.2.raw
  modified_base (219)..(219): a, c, t, g, unknown or other
  misc_feature (219)..(219): n is a, c, g, or t
  modified_base (400)..(400): a, c, t, g, unknown or other
  misc_feature (400)..(400): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcattccttttcttggtggcagcagcaactggtgcccgctctcaggttcaattggtgcagtctggacctgaggtgaagagccgtggggcctnagtgagtctctgcaggtcttcgtggttactacggtttaggagtctagttggtattcggtttggggtgcgacgcggcccctggacacggctgagtggagtgggatggatcgtaacccgttgaaaggaacaacgaaatgtacgacgagaggacgcccctacggaggcaggtacgtaccaacgngtcgacccgacaacgaccaaccgaacctaaaccgacccacgtaacgaccctaacgagtcggggtaagttaggacgggtaagttacgaggtaccgtaccgtacggaaaccggaccggtaaccggtacccgttaagttaaccgttaaccgtcggacggtacggaacgggtacgggttaccgtttacgtacgggtagtaaccggttagttacggtaagttacgttaccgtacggacggtacgcgggttaccgggaccggtacgggacccgtaccggtcggtaccgttaccgg

SEQ ID NO: 314124 - DNA, 725 bp, Homo sapiens
  misc_feature: GZ8MTXP02HN9FF.22.41.D08.1.454.CMB.2.raw
  modified_base (218)..(218): a, c, t, g, unknown or other
  misc_feature (218)..(218): n is a, c, g, or t
  modified_base (424)..(424): a, c, t, g, unknown or other
  misc_feature (424)..(424): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcattccttttcttggtggcagcagcaactggtgcccgctctcaggttcaattggtgcagtctggacctgaggtgaagagcctggggcctnagtgaaggtctcctgcaaggcttcgtggttacacgtttaggagtctagtggtattcggtttggggtcgacgtacacggcccctggaaccaacggcctaggagtggagtgggaagtggatacggtaacccgttagtaaagggaaaactacgtaaaacttgcgacaaggacggaacggtcccaccggaaggggcaagtacgaccacgngtcgaccgcacgaaccaaccgaaacccaacgtacccaaacgtacgacccctaaagtagtaggggtacggttacggtaagggtaacgtcgtaacgaacggttacccgtaacgggaaccgaaccggtaccgggtaccttaaagtttacgttaaaccgcgggaccggtaacgggaaacggggtacgggtttccgttttacggaaaccgggtttagtaaccggttagtagggtaaccttagtcgtacgaacggccgtaacggcgggggaccacggggtcctaccccgggttgtttaccgtaccgg

SEQ ID NO: 314125 - DNA, 634 bp, Homo sapiens
  misc_feature: GZ8MTXP02G79A9.22.41.D08.1.454.CMB.2.raw
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
  modified_base (572)..(572): a, c, t, g, unknown or other
  misc_feature (572)..(572): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcctggggcctcagtgaaggtctcctgcaaggcttcgtggttaacacggtttaggagtctagtggttattcggtttggggtgcgacacggcccctggacaacggcctgaggtggatggggatggatcgtaaaccccgttagtaaaagggaaacaaccgaaaacttagtcggacaaggaagacggccctacgacggacaaggactacaccagtcgaaccgcacgacaacaaccaaaccgaccacacgactacagtaggagttgacggatcgngaagtaccnggaaaccgacgtaccgggcttaagtacttacgtgcggacggaggtacgggtcgtttacgtacggtagtacgtacgtagaggttaacncgttacgaacggcgtaaccgggtcgggacccgacggggtaccctaccgtcggttactaccgg

SEQ ID NO: 314126 - DNA, 610 bp, Homo sapiens
  misc_feature: GZ8MTXP02F8T3Q.22.41.D08.1.454.CMB.2.raw
  modified_base (217)..(217): a, c, t, g, unknown or other
  misc_feature (217)..(217): n is a, c, g, or t
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
  modified_base (447)..(447): a, c, t, g, unknown or other
  misc_feature (447)..(447): n is a, c, g, or t
  modified_base (462)..(462): a, c, t, g, unknown or other
  misc_feature (462)..(462): n is a, c, g, or t
  modified_base (510)..(510): a, c, t, g, unknown or other
  misc_feature (510)..(510): n is a, c, g, or t
  modified_base (571)..(571): a, c, t, g, unknown or other
  misc_feature (571)..(571): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactgggtgcccgctctcaggttcaattggtgcagtctggacctgaggtgaagagccgtgggctnagtgagtctctgcaggcttgtggttacacgtttaggngctatggtatcggtttggncgacacggcccctggacaacggcctggagtggagtggagtggatcggaaccctttaggtaaaacgggaaacaacgaaacttagtggacagaggaggcccgtaccggagggacaaggacgtccaccgtagtacgaccgacaacgaccaacgaacccaacgaccacgacgacctanagtggagttcgaggnttcgagacgaccgtagaaccgacgacgggtaccttaatacttaccggngacgaggtacggtaggttacgttacgacggtactacgttagtacgtacttacgtcgtacgnggaccgaacgggtcggacgacggccgtcgtacgtactcg

SEQ ID NO: 314127 - DNA, 625 bp, Homo sapiens
  misc_feature: GZ8MTXP02GK2AM.22.41.D08.1.454.CMB.2.raw
  modified_base (322)..(322): a, c, t, g, unknown or other
  misc_feature (322)..(322): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctccgtgcaaggtcttctggttactacgtttaggagctagtggttattcggtttggggtgcgacgacggcccctggacaacggcctggagtggngtgggatggatcgaacccgttacgtaaagggaaacaacaaactgtagacagagacgcctacgaggcagactacacagtcgaccgacagaaccacgaaaccgaaaccgaaccacaacggccctaacgagtggtaacgtagacggacgtacgagacggtacacggaaccgacggacgtaacccttaattaccgttaccgcggtacggaacggaggggtacggttacgtttacggacggtagtacgtagttacgtaggtactcgtacgcgacgtcggcggacggtacgaccgtccggtagccgtcg

SEQ ID NO: 314128 - DNA, 629 bp, Homo sapiens
  misc_feature: GZ8MTXP02FIY6C.22.41.D08.1.454.CMB.2.raw
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagccgtggggcctcagtgaaggtctcctgcaaggcttctggttacacggtttaggngtctatggtatcggtttgggngcgacaggcccctggacaacggcctgagtggagtgggatggatcgaacccttagtaaagggaaacacaaactatgacagagaggccctaccgagggcagacgtcacntcgaccncacgaccaacaacccaaacgacccacgacgccctacatgggagttacggaggtaagtctagacgacctaggaacgaccgacggtaccgttaatacgtttaacgcggacggacggaagggtacggggtacgttttacgtaacgggtagtaccgttaagtcgtaagttacgtccgtacgacgggctaacgggtcgggggaccctacgggggccctaacccggtcggtactaccgg

SEQ ID NO: 314129 - DNA, 609 bp, Homo sapiens
  misc_feature: GZ8MTXP02H86J5.22.41.D08.1.454.CMB.2.raw
  modified_base (377)..(377): a, c, t, g, unknown or other
  misc_feature (377)..(377): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttggtgcgacaggcccctggacaacggcctgagtggatgggatggatcgaaccccttgtaaagggaaacacaaactatgacagagaggcctcgaggcagatcacntgacgcagaccacaccaaacgaccacacgcctaacagtaggagttcggaggacgtcgtagacgtacctcgaaccgaacgaccgggtacccgttaagtaacttacgtcggacggaccggaggtacggggttacgtttacgtaaccgggttgaaccgttagtacggtaagttactcgacgaggtacgaacggtccgggggaccgacggggtacctacccggttggtacctacgg

SEQ ID NO: 314130 - DNA, 562 bp, Homo sapiens
  misc_feature: GZ8MTXP02FGIBC.22.41.D08.1.454.CMB.2.raw
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
tcagacatacgcgtcacgaccggtgctcgatttagtcacgcgagaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagatggcctagttttggcagccaccacgaagggggtcggatccctgactcgcttcgcgggctccagctcgtcggggccagcgctacncacntcctcacgcctcagtctagaagatgaggctgactatactgtacagacagtgggacgcgtggcgtctgggctggttcggcgggagggaccgaagcgtacggaccgtccgtaggtccacgcccgaaacggccgtccgcccccgtcggtcccacgttccgtaccgttcccccacccgtccctcgtaccgg

SEQ ID NO: 314131 - DNA, 678 bp, Homo sapiens
  misc_feature: GZ8MTXP02G41G3.22.41.D08.1.454.CMB.2.raw
  modified_base (424)..(424): a, c, t, g, unknown or other
  misc_feature (424)..(424): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctgacctgaggtgaagagcgttggcctcagtgaaggtctctgcaagtcttctggttactacgtttaggagtctagtggtattcggttggggtgcgacgacggccccgtaggacaacggcctggagtggagtgggagttggatacgtaacccttagtaaaacgggaaaccaacgtaaactatcggacaaggacggacggcccgtaccgagggcaagtacgtaccacgtagcgacccgnaacgaccaacgaaccaaccgaccagtacgaccctaagagtggtaagttggaggacgttacgacgaaccggaacgtcggaaacgccgtaacgggtccgttattaacgttacgcggaccggtagacgggtacggttacgtttacggtacgtacgtacgttaagtaggtaacttacgttacccgaggtacgggaccgtaacggggttaacggggccgtaaccgggggtacccttcggtttaccggaactttcccggg

SEQ ID NO: 314132 - DNA, 658 bp, Homo sapiens
  misc_feature: GZ8MTXP02I0YKE.22.41.D08.1.454.CMB.2.raw
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagcgtgggcctnagtgaagtctctgcagcttctggttacacgttagagtntagtggtatcgttggncgcacgccctgacacgctgagtgatggatggatacgaacccttagaaacggaaactacaaactatacgacgaagacgacggcctaccgaggggcacggacgtaccacgtagtccgaccgacaacgaaccaacgaaacccaaacgacccaacgacgaccctaacagttacgaaagttacggaggtagcctagacaaacgtcgaacggtacaccggtaccttaagtacgtacgtcggacgacgggtaggtccggggttacctttacgggtaacggttcgtaaacgttagttacgggtaaacttccgtttacgaacccggtaggtacccgaaccggggttaacgggggcccttaaccgggggcccttaccggtacgggttaccttacccgg

SEQ ID NO: 314133 - DNA, 584 bp, Homo sapiens
  misc_feature: GZ8MTXP02JVAO6.22.41.D08.1.454.CMB.2.raw
  modified_base (435)..(435): a, c, t, g, unknown or other
  misc_feature (435)..(435): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttctggtggcagcagcaactggtgcccgctctcaggttcaattggtgcagtctggacctgaggtgaagaagcctggggcctcagtgaaggtctcctgcaaggcttctggttacacgtttaggagctatggtatcggtttgggtgcgacacggcccctggaccaacggcctggacgtggatgggactggactgaacccttacgtaaagggaaaccacaaactatcgacaagacggaggccctaccgaggggccaaggtgtccgactagtcggaaccgacacgacacacccaacgaacccanacgactaacgatggagttgaggagtctgacgactggacacgcgacctagtatacgtgacgcggagacgggtcgtttacgacgttcgactagtcgagttactcgacacggcaacgtagggggaccacggggaccacccggtggtacctcg

SEQ ID NO: 314134 - DNA, 674 bp, Homo sapiens
  misc_feature: GZ8MTXP02JM0P6.22.41.D08.1.454.CMB.2.raw
  modified_base (166)..(166): a, c, t, g, unknown or other
  misc_feature (166)..(166): n is a, c, g, or t
  modified_base (325)..(325): a, c, t, g, unknown or other
  misc_feature (325)..(325): n is a, c, g, or t
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
  modified_base (483)..(483): a, c, t, g, unknown or other
  misc_feature (483)..(483): n is a, c, g, or t
  modified_base (497)..(497): a, c, t, g, unknown or other
  misc_feature (497)..(497): n is a, c, g, or t
tcagacatacgcgtcacgaccggtgctcgattttagtcacgcgagaaagggaaaggggacccaaaaaccacacccctccttgggagaatcccctagatcacagctcctcaccatggactggacctggagcatccttttcttggtggcagcagcaactggtgcccgntctcaggttcaattggtgcagtctggacctgacggtgaagagcgtggggcctcgagtgaaggtctccgtgacaaggtcttcgtggttacacggtttaggagtctagtggtagttcggttgggtgcgacgcggccctggacaacggccgtggagtacggngtggagtggactacgtaaccttagtaagggaaaacacgtaaactgtcgacgagacgagccccgtacgagganaggtactaccgacngtacgaccgatacgaccaacgaaccgaccgtaaccacgtaccgacacgtacgtaggattggagtacccgtanacgaacgtaaccgngaaccggaccgtaacggtaccgttaagttaccttacggacggtacccggaaggtacgggtacggttaccggtttacgacggggttactaccgttaggtacgtaaaggtcctacggtacgaccggttacggtaacggtaccgggaccgtaacggtccggtaaccctggggtactccgg

SEQ ID NO: 314135 - DNA, 709 bp, Homo sapiens
  misc_feature: GZ8MTXP02GBLQX.22.41.D08.1.454.CMB.2.raw
  modified_base (498)..(498): a, c, t, g, unknown or other
  misc_feature (498)..(498): n is a, c, g, or t
  modified_base (631)..(631): a, c, t, g, unknown or other
  misc_feature (631)..(631): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagacgcgtgggcctcagtgaaggtctctgcaaggtcttcgtggttacacggtttaggagtcttagtggtagttcggtttggggtgcgacgacggtccccgtagggaactaaccggcctaggacggtggacgtgggagtaggactacggtaaccttaaggaaacgggaaaacaacaaatagtgacaggtagcgacctaccggaggcgacgacgtaccaacagtcgaccgacacgtaccaaaccacaacccgaccacgacgtacccgaagagttagggacgttagacgtaaccggttnacggacaacccgtgaaaccgccgtaccggggtacctaagttaccttacggcgacgggtaacggtacggggtaggtttccgttttaaacgcggggttaaacgttaccgtagggttaacgtacggtttaaacccnccggttaacgacgggtaccggttaaccggggaccggggtaccggacggttacccctaccgggtacggttacccgtccg

SEQ ID NO: 314136 - DNA, 691 bp, Homo sapiens
  misc_feature: GZ8MTXP02IVDFQ.22.41.D08.1.454.CMB.2.raw
  modified_base (227)..(227): a, c, t, g, unknown or other
  misc_feature (227)..(227): n is a, c, g, or t
  modified_base (402)..(402): a, c, t, g, unknown or other
  misc_feature (402)..(402): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagctgggctcagtgaggtctccngcaaggcttcgtggttacacggttttaggagtctagtggtattcggtttgggtgcgacacggcccctggaccaacggcctgagtggagtgggatggatcgaaacccttgtaaaggaaacaacaaactatagacaggaagacggcctacccggagggacaaggtacgtaccaaccngtacgacccgcacgaccacgaaacccaaacgacccacacgaccctaacgagttacgggagtttcggaaggtacgttacgacggaacgtacccgtaggaaccggaaccgaccgggtacccgttaattaccttaccgtggacgaccgggtaagtacgggggttaccgtttacgtaaccgggttagaactttaggtaccgtaaggttaacgttccgtaaacggtcggaaccgtaaccgggttaccggggacccggtaaacgggcccgtaaccccgttcgggtacctaacccg

SEQ ID NO: 314137 - DNA, 720 bp, Homo sapiens
  misc_feature: GZ8MTXP02HO9PK.22.41.D08.1.454.CMB.2.raw
  modified_base (165)..(165): a, c, t, g, unknown or other
  misc_feature (165)..(165): n is a, c, g, or t
  modified_base (443)..(443): a, c, t, g, unknown or other
  misc_feature (443)..(443): n is a, c, g, or t
  modified_base (522)..(522): a, c, t, g, unknown or other
  misc_feature (522)..(522): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgntctcaggttcaattggtgcagtctggacctgaggtgaagagccgtgggcctcgagtgaaggtctcgtgcaaggtcttcgtggtaactacggtttaggagtcttagtggtattcggttgggtgcgacgacggtccccgtggaaccgaaccggccgtaggacgtggagtggggagtggatacgtaacccgttagtaaaacgggaaaacaacgtaaaactagtacgactaaggagtacgccctaccggaagggtcaaggacgtccgacgagtcgggaaccncgaaacgtaccaaccaaccgaaaccgacccaactaccgactaacgagtaggagttcggagtacgtcgtagactaaccgngaaccgaacggacgtaccgttaagttaacgttacgcgaccggtacggaggttaccgggtaccgttttacgggaacggttacgtaccgttaacgtaggttaacgtacgtttaaccccgggacggtaacggtaccggtaacggggtaaccggggacccggtaaccgggtacccgtttaccggtccggtttacccgtacgg

SEQ ID NO: 314138 - DNA, 691 bp, Homo sapiens
  misc_feature: GZ8MTXP02GWVR2.22.41.D08.1.454.CMB.2.raw
  modified_base (217)..(217): a, c, t, g, unknown or other
  misc_feature (217)..(217): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagccgtgggcctnagtgagtctctgcaaggtcttgtggttacacgtttaggacgtcttaagtggttagttcggtttggggtcgacggacgacggtcccccgtaggaaccaaccggtcctaggaggtaggagtgggagtggatacgtaacccttaggtaaaagggaaaccaacgtaaaactagtacgaacgaaggacggaggaccccgtaccggagggacctaaggacgtaccgaaccgagtaccggaaccgcgaaacgacccaacgaaacccaaaccgaaccaacgtacgacctaagacggtaggacgttacgaggtacgttacgagacgtacgtacgacgacgtaccggacgttaatacttacggcgacggacggaaggtacgggttacgtttcggacggttacgtaacgttagacggtatacgttacccgagaacggcggtaacggtacgggaccggtacggacctaccgggtacgtacgttccg

SEQ ID NO: 314139 - DNA, 697 bp, Homo sapiens
  misc_feature: GZ8MTXP02II3YI.22.41.D08.1.454.CMB.2.raw
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtagaagaagccgtggggcctcgagtgaaggtctccgtgacgaaggtcttcgtggttactacgttaggagtctagtggtatcggttgggtgcgacgacgcccgaggaccacggcctgagtggagtggagtggatacgaaccgttagaaacgggaaacacgaaattgagacgagaggacgccgtacggaggacaggagtaccaacgagtccgaccgaacgacgaccaaccaaacccaaaccgaccaaccgactacctaacaggtaggtagttagggaacgtacgtcgtacgacgaccgtagaaccgtacgacggtacttaggtaacttaacgccggacggtacggaacggggttacggtacccgttttacgaccgggtacgaccgtttaggacggttaaccgtttaggttaccgaacgggtcccggtaacggggtcccggggtaccggtaaacgggggtacccaacccggggtttcgtacccgttaacggtttcccccgg

SEQ ID NO: 314140 - DNA, 837 bp, Homo sapiens
  misc_feature: GZ8MTXP02JMHTC.22.41.D08.1.454.CMB.2.raw
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagagctgggcctgagtgaggtctccgtgacgaaggtcttgtggttactacggtttaggagtctagtggtagttcggtttggggcgtacgacgtacggtcccctagggaaccgtaaccggccgtaggtaggtagggtagttaggggattacgggtacttacggtaaacccccgtttaaggtaaaaccggggaaaactaaaccgtaaaacttacgtacgaaccgtaaaggacgggacggtcccccgtacccggaggggacccaagggttacccgaccgtaaacccgaggttaccgggaaacccgaacgaacccgaacccgtaaacccgaaaacccgaaacccggtaaacccaaaccgaaccggttaacccaacgtaaggtacgggtaacggttacgggacggtttaaacgtcccgaaggacccgtaaaccggacggaaacccggtaccgaacccgggtttaacctaacgtttaaacgttcccgacgggacggaacgggtaacgggtaccggggttaccttttacgggaaccggttagaaccttttggaaacggttacgttcttacggacgtaccggggtacgtaaccgggggtcggacccggaacggccccgtacccggtttaggacctttacccgg

SEQ ID NO: 314141 - DNA, 773 bp, Homo sapiens
  misc_feature: GZ8MTXP02HN35Y.22.41.D08.1.454.CMB.2.raw
  modified_base (366)..(366): a, c, t, g, unknown or other
  misc_feature (366)..(366): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaagttggtgcagtctggacctgaggtgaagagcctgggcctcagtgaggtctcctgacaggcttcgtggttactacggtttaggagtctagtaggtagttcggtttgggcgcgacgacggcccctggacacggctggagtggagtggatggactcgtaacccgttagtaaaacgggaacaacgtaaactancgacgtaggaaggtacggccccgtaccgaggaccgaggtacgtaccgaacgacgtacgggaaaccacgaacgaacccacccgaaaccgaaacccgaacccgtaacgaaccgtaaccctaacgtagttaacggggtagttagggtaacggaggttaccgtaacggaacgttaccggcggaaacccggaacccggggttaaccggtacccggttaactttaacgtaccggttacggacggtacccgggaaggggtaacgggtttccggtttaacccgggttaacggttcggtaaacgttagggtaacggttaaaggttaccgtttacgtaccggacgggtaccgtaaccgggggttcgggggaaccggtaacccggggtccgtaccccgggtttgggttacccgtccgg

SEQ ID NO: 314142 - DNA, 665 bp, Homo sapiens
  misc_feature: GZ8MTXP02JATDT.22.41.D08.1.454.CMB.2.raw
  modified_base (258)..(258): a, c, t, g, unknown or other
  misc_feature (258)..(258): n is a, c, g, or t
  modified_base (476)..(476): a, c, t, g, unknown or other
  misc_feature (476)..(476): n is a, c, g, or t
  modified_base (643)..(643): a, c, t, g, unknown or other
  misc_feature (643)..(643): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcattccttttcttggtggcagcagcaactggtgcccgctctcaggttcaattggtgcagtctggacctgagtgaagagccgtgggcctgagtgaggtctcgtgcaagtcttctggttactacgtttaggngtcttagtcggtattcggtttggggtgacgacgaccggccccgtaggaaccgaacggccgttaggacggttggagtagggagttaggacgttacgtaaacccttaggaaaacggaaacaacgtaaactgtacgacaggaaggacgccgtaccgaagggcaagcgtaccacagtcgaccgagacgaccaacaccgtaacgaaccgataccgaccgtaanggttacggagttggaacggtacttcggaagacgtaaacctacgggaaaccgaccggtaacggtacccttaaagttccgttaaacggcgccggaagggttggaccggtttactttccggagggtacctaggtacttagggaactgttccaaggcgctaagggcgaacncggacctccggtcggaatcccg

SEQ ID NO: 314143 - DNA, 709 bp, Homo sapiens
  misc_feature: GZ8MTXP02FZZXR.22.41.D08.1.454.CMB.2.raw
  modified_base (495)..(495): a, c, t, g, unknown or other
  misc_feature (495)..(495): n is a, c, g, or t
tcagacatacgcgtcacgaccggtgctcgatttagtcacgcgagaaagggaaaggggacccaaaaaccacacccctccttgggagaatcccctagatcacagctcctcaccatggactggacctggagcattccttttcttggtggcagcagcaactggtgcccgctctcaggttcaagttggtgcagtctggacctgaggtagaagaagccgtgggcctcgagtgaaggtctccgtgcgaaggtcttctggttaactacggtttaggatctagtggtagttcggtttgggtgcgacgacggtccccgtaggacgaacggcctaggagtggagtgggataggatacgtaacccgttagtaaacggaaacaactaaactagtagacgagaagtacgcccgtacgaggacaaggactaccgactagccgaccgacaaccgaccaaccaaccaaacccgaacacgtaaccaccctagtagaggttacgtgggaacggngttacgacggacgtaccgaacggaaccggtaccggtaacccgtacgtttaaagtaaccgtttaacccggcgggtaccgggtacgggtaacgggttaccgggtttaccggtttacggaacggttacgtaacgttaggtacggtaaacttacgtacggtacgacggtaccggtaaccgggtccgggaccgaccggtacctaccggttcgtacgtcg

SEQ ID NO: 314144 - DNA, 634 bp, Homo sapiens
  misc_feature: GZ8MTXP02I61MM.22.41.D08.1.454.CMB.2.raw
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
  modified_base (403)..(403): a, c, t, g, unknown or other
  misc_feature (403)..(403): n is a, c, g, or t
tcagacatacgcgtcacgaccggtgctcgatttagtcacgcgagaaagggaaaggggacccaaaaaaccacacccctccttgggagaatcccctagatcacagctcctcaccatggactggacctggagcattccttttcttggtggcagcagcaactggtgcccgctctcaggttcaattggtgcagtctggacctgaggtgaagagcgtgggctgagtgagtctctgcagcttgtgttactacggtttagntntagtggtagttggttggngcgcgccggccctaggacacggctggagtggagtggagtggtactaccgtaaccgttagaaacgggaaaactaactaaacgtgacgacgagacgacgcctacgaggcgaagtacgccaacgtgcggaacnctaacgaccacgaacctaacgacacgtacacccagacgtggtaagtcggaaggtactagacggtacgacgtaggaccgtacgtacggtaccttagttaaccgtcgcggtacggaccggtaagggtcggttacgttacggtacggtattacgtaaggttacgtaactcgttaccgacggacgtaccggaacggggtccggaccgaacgggtctaccggtcggtacctacccg

SEQ ID NO: 314145 - DNA, 507 bp, Homo sapiens
  misc_feature: GZ8MTXP01DJN7P.3.71.G05.1.454.CMB.2.raw
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagccctnaagaagctaattangcaagctggtaccagcaagaagccaggacacggcccctgtactgcatctatacggtaaaaacaccggcctagacgggactcccagaccgattctctggactccagctacaagaacacagcttctgaccatcacgtgggctcgagcgaagatgagctgactatactgtaacgtccggcagcagtcgtaanttgngtatagtcggnggaaggacaaggtcgaccgtctacgcgcgacccaagcctcgccccctggctaacttcgtcccg

SEQ ID NO: 314146 - DNA, 500 bp, Homo sapiens
  misc_feature: GZ8MTXP01DDXT7.3.71.G05.1.454.CMB.2.raw
  modified_base (392)..(392): a, c, t, g, unknown or other
  misc_feature (392)..(392): n is a, c, g, or t
  modified_base (494)..(494): a, c, t, g, unknown or other
  misc_feature (494)..(494): n is a, c, g, or t
tcagagacgcactccacgaccggtgctcgatttagtgtcgtcgcaagagagaggggcagaagcagagttctgggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgcatctataggtaaaaacaccggccctcgagggactcccagaccgattctcctggctccagctacaaggaacacagcttcctgaccatcactgggctcgaggcggaagatgaggcngactattactgtaacgtcccggcagcagtgtaacattgtgtatagtcggcggaaggaccaagcttgaccgtcttaggttcagccaagctcgccccttgtccncgtccg

SEQ ID NO: 314147 - DNA, 562 bp, Homo sapiens
  misc_feature: GZ8MTXP01D8K1K.3.71.G05.1.454.CMB.2.raw
  modified_base (235)..(235): a, c, t, g, unknown or other
  misc_feature (235)..(235): n is a, c, g, or t
  modified_base (349)..(349): a, c, t, g, unknown or other
  misc_feature (349)..(349): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattangcaagctggtaccagcagaagccaaggacacggcccctgtacttgtcatctataggtaaaaacaccggcctcgaggactcccagaccgattctctggctccagctacaagaacncagcttcctgaccatcacgtggggctcgaggcgaagagtgaggctgactattactgtaaccgtcccgggactaagcctaggtcggtaaactgtttagtgtaattagttcggggcgggaaaggggacccaaaggggtcgaacccgttccgtaacgttcgacggaccccgaagggccttccggcccccgtgggttcctaaccgttccgttcccgg

SEQ ID NO: 314148 - DNA, 521 bp, Homo sapiens
  misc_feature: GZ8MTXP01CLWRC.3.71.G05.1.454.CMB.2.raw
  modified_base (346)..(346): a, c, t, g, unknown or other
  misc_feature (346)..(346): n is a, c, g, or t
  modified_base (380)..(380): a, c, t, g, unknown or other
  misc_feature (380)..(380): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctattatgcaagctggtaccagcagaagccaggacaggcccctgtactgcatctataggtaaaaacaccggccctgaggactcccagaccgattctcctggctccagctacagaacncagcttctgaccatcacgtgggctcgaggcgaantgagctgactatactagtaaccgtcccgggcagcaagtgaactgttagtgtacttagtcgggcggaagggacccgaaagggtcgacccgtactacgttcgacgcccgaaggcctcgccccctggttccaacgttcgtcccg

SEQ ID NO: 314149 - DNA, 627 bp, Homo sapiens
  misc_feature: GZ8MTXP01EA3RU.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagacagaacgccaggacacggcccctgtactgtcatctaataacggtaaaaaacacccggacccctacgaacgggactaccccgaacgaccgtattcctcctcggcctacccgagcctaacgaacggaacacacgtcctttacccttacgaaccctataccgacggtcgggggacctacggacgggacggaaagagtggacggctagacttattacgtacgtaaccggtcccggggactagcgaagttacggtaactagttgtagtattaggtcgggacgggaacggtaaccgaagggtcgttacccggtcgtacgttacgacgacccgaaggtccgtccggtcccccgtaggttccctaaccgttcccgttaacccg

SEQ ID NO: 314150 - DNA, 574 bp, Homo sapiens
  misc_feature: GZ8MTXP01CALFK.3.71.G05.1.454.CMB.2.raw
  modified_base (235)..(235): a, c, t, g, unknown or other
  misc_feature (235)..(235): n is a, c, g, or t
tcagagacgcactccacgaccggtgctcgatttagtgtcgtcgcaagagagaggggcagaagcagagttctgggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctattangcaagctggtaccagcagaagccagacagcccctgtacttgtcatctaataggtaaaaacaccggccctacgaggactacccagaccgattctcctggctcagctaacgaaggaacacagtccttctagaccatccacgtcggggctacgaggacgaagatggagctagactatactgtaaccgtcccgggacagacagtacgtaacagtttcgtggtaacttagttccggggacgggaacggggaacccttagggtaccgacccgttaccgtacgttcgaccgccccgaagggtccctcggtcccccccgtggttacctaaccgttttccgtcccccg

SEQ ID NO: 314151 - DNA, 568 bp, Homo sapiens
  misc_feature: GZ8MTXP01BZQWX.3.71.G05.1.454.CMB.2.raw
  modified_base (228)..(228): a, c, t, g, unknown or other
  misc_feature (228)..(228): n is a, c, g, or t
  modified_base (391)..(391): a, c, t, g, unknown or other
  misc_feature (391)..(391): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggttttcttctgagctgactcaggaccctgctgtgtctgtggccttgggacagacagtcaggatcacatgaccaaaggagacagcctanaagaaagctaattatgacaagctaggaccagacaagaagccaaggacacggcccctgtactgtcatctaataagtaaaaacaccggccctagaggactcccagaccgattctctggctccagctaacaagaacacagtccttacctagaccatcacgtgggcncgaggagaagatgagctagactatactgtaacgccggacagcgagtagtaactattagtcgtaataagttcgggcgggaaagggaaccgaaagggttcgacccggtaccttaacggttaccacggaccccgaaagggcccttcgccccccgtacggttccaaccttccgttccccgg

SEQ ID NO: 314152 - DNA, 583 bp, Homo sapiens
  misc_feature: GZ8MTXP01B2KKM.3.71.G05.1.454.CMB.2.raw
  modified_base (216)..(216): a, c, t, g, unknown or other
  misc_feature (216)..(216): n is a, c, g, or t
tcagagacgcactccacgaccggtgctcgatttagtgtcgtcgcaagagagagggggcagaagcagagttctggggtgtctccaccatggcctggacccctctctggctcactctcctcactcttgcataggttctgtggtttcttctgagctgactcaggaccctgctgtgtctgtggccttgggacagacagtcaggatcacatgaccaagganacagcctcagaagctattatgcaagctggaccagcagagccagacacggcccctgtactgcatctatacggtaaaaacaccggccctacagggactcccagaccgattctcctcggctccagcctacaaaggaacacagccttcctgaccatccacgtggggcctcgagggacgaagagtgaggctagacttatactcgtaaccgtcccgggacagacgtagtaggtaactagttgtagtaattagttccgggacgggtaaaggggaacccttaaaggggtccgacccgtaccgtacggttacgacggaccccgaagggtccctccggcccccccgtgggttaccctaaccgtttccgttaaccccg

SEQ ID NO: 314153 - DNA, 544 bp, Homo sapiens
  misc_feature: GZ8MTXP01CBY5P.3.71.G05.1.454.CMB.2.raw
  modified_base (365)..(365): a, c, t, g, unknown or other
  misc_feature (365)..(365): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcgggatcacatgccaaggagacagcctcagaagctattatgcaagctggtaccagcagaagccaggacaggcccctgtacttgcatctaatacggtaaaaaaccaccggccctacgaacgggactccccgagaccgtattctctcggcctcagcctacgaaaggaaaccncagtccttcctagaccatcacgtggggactcgagggcgaagatggagctgactatactgtaaccnccgggggacagcaggtgtaacngttgtagattagtcggacggagggaaccaagggttcgaacccgttcgtacgtcacgcccaaggcctcgccccttggcacgtcttcgtccccg

SEQ ID NO: 314154 - DNA, 523 bp, Homo sapiens
  misc_feature: GZ8MTXP01C5BEX.3.71.G05.1.454.CMB.2.raw
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
  modified_base (422)..(422): a, c, t, g, unknown or other
  misc_feature (422)..(422): n is a, c, g, or t
  modified_base (437)..(437): a, c, t, g, unknown or other
  misc_feature (437)..(437): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctcaagaagctattatgcaagctggtaccagcaagaagccaaggacacggcccctgtactgtcatctaataggtaaaaaccaccggccctacgaggactaccagaccgatctcnggctcagctaacagaacncagcttctgaccatcacgtgggctcgaggcgaagatagagctagactatactgtacgcgtcccggaanaacgagtacgtaacngtagtgtatcgggcgagggtaaccaaacgttcggaccgttcgtaggcacgccaaggcctcgcccctaggcactcgttcgttccccg

SEQ ID NO: 314155 - DNA, 546 bp, Homo sapiens
  misc_feature: GZ8MTXP01EZW0C.3.71.G05.1.454.CMB.2.raw
  modified_base (237)..(237): a, c, t, g, unknown or other
  misc_feature (237)..(237): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (477)..(477): a, c, t, g, unknown or other
  misc_feature (477)..(477): n is a, c, g, or t
  modified_base (535)..(535): a, c, t, g, unknown or other
  misc_feature (535)..(535): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaagaagctattangcaagctggaccagcagaagccaggacaggcccctgtacttgcatctaataggtaaaaaaccaccggccctagagggactcccgagaccgattctctcggctccagcctaacgaaggaaccacacgtcctttaccttagaaccctatccgacgtggggacctcgagggacggaagagtgaggctagactattactgtaaccgtcccgggcagcaggtgtaacngttgngtatagtcgggnggaaggaccaggtcgaccgtctacgttcgacgccccgaaggcctcgcccctggttccncgttccgtccg

SEQ ID NO: 314156 - DNA, 550 bp, Homo sapiens
  misc_feature: GZ8MTXP01CX2PQ.3.71.G05.1.454.CMB.2.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (358)..(358): a, c, t, g, unknown or other
  misc_feature (358)..(358): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctnaagaagctaatangcaagctggtaccagcaagaacgccaaggacaggcccctgtactgtcatctaataggtaaaaacaccggcctacgaaggactccagaccgattctcctggctccagcctaacgaacgaacncagtccttcctgacatcactgggctacgaggacgaagactgaggctagactaatactgtaaccgtcccgggacagcgagtaggaactagttgtagtatacgtcggcgggaaagggaccgaagggtcgacccggtactacgttcgacgacccgaagggcctccgcccccttaggcctaacttccgttaacccg

SEQ ID NO: 314157 - DNA, 569 bp, Homo sapiens
  misc_feature: GZ8MTXP01CKJO6.3.71.G05.1.454.CMB.2.raw
  modified_base (222)..(222): a, c, t, g, unknown or other
  misc_feature (222)..(222): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtgccttggacagacagtcaggatcacatgaccaaggagacagcctnaagaagctaattatgcaagctggtaaccagcaagaagccaaggacaggcccctgtactgcatctatagtaaaaacaccggcctgaaggactaccagacgtatctcctggctacgagctaacgaaagaacactaagtccttactacgaccctatcgaacgtcgggactacgaggacggtaagagtcgaggtcatactattactacgtacggcccggacgagacgtaagtacgtaangttagngtaagtgttacgggacgggaacggaaccaagggtcgacccgtacgtacgttcgacgacccgaagggcccttccgcccccgtggttacctcgttccgttaacccccg

SEQ ID NO: 314158 - DNA, 673 bp, Homo sapiens
  misc_feature: GZ8MTXP01CHJ3I.3.71.G05.1.454.CMB.2.raw
  modified_base (310)..(310): a, c, t, g, unknown or other
  misc_feature (310)..(310): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtcgtgggggaggcttggtacagcctggcaggtccctgagactctcctgtgcagcctctggattcacctttgatgattatgccatgcacgtgggtccgnagctccgagggaggcctggagtgggtctccgaggtattacgttggaataagtgaataacagtcgggctagtcggacgacttcgtggtaggtaacggggcccgtattccgaacctattccgtacccaggacgaaaccaaccggacccaaacggggaaccttccccgtagttaacttctacggtaaccaaaagttacggaaactacggttacgtacggaacggtaaccccgttaggaaaccgggtaccgaaccggggttacccttttagggttaaccttttacggttacgggttaacggttaaaacgggttccccgggggtaaaattacggttacggttaaccggtttaagttttttaaccgggg

SEQ ID NO: 314159 - DNA, 542 bp, Homo sapiens
  misc_feature: GZ8MTXP01DBN3Y.3.71.G05.1.454.CMB.2.raw
  modified_base (369)..(369): a, c, t, g, unknown or other
  misc_feature (369)..(369): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttcctttggctattttaaaaggtgtccggtgtgaagtgcaactggtggagtcgtgggggagcttggtacagcctggcaggtccctgagactctcctgtgcagcctctggattcacctttgatgattatgccatgcacgtggtccggcaagctccgagggacgggcctgggagtgggtctcgagggttattacgttggaatagtgaaataacngtcggactagtgcggactctgtgaagggccattcacatctccagagacaacgccaaagaacctcccgtagtatcctgacaaatgaacagtctgagcctggaaggtacacggtaccttgtattacttgttgttaaacggtccggggaaatgtgtacgttattttcggaactttc

SEQ ID NO: 314160 - DNA, 753 bp, Homo sapiens
  misc_feature: GZ8MTXP01BJ3PV.3.71.G05.1.454.CMB.2.raw
  modified_base (224)..(224): a, c, t, g, unknown or other
  misc_feature (224)..(224): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnagaagctattatgacaagctggtaccagcagaagccaggacacggcccctgtacttgtcatactaatacggtaaaaaccaccggccctacgaagggactcccgagaccgtattcctccgtcggctccgagcctaacgaacgggaaccacgacgtcctttacccttacgaaccctacgttaccacggttcgggggacctacggaacggggaccgggaaagtagttacgggaggtaccgttaggaaccttaagtttaaccgttacggttaaaccccggggttccccgggggtaaccacgggaccgtaagggttaccgggttaaactacggttttacgggtaagtaacggtttaacgggttcccgggggacgggggaaaccgggggtaaacccttaaacgggggtacccgttaaccccgggttacccgttaacccgggttaaccgacccgggacccccggtaaacgggtcccgttccccgggtccccccccggttacgggttaccccttcccgtttcccgtttaaccccccg

SEQ ID NO: 314161 - DNA, 655 bp, Homo sapiens
  misc_feature: GZ8MTXP01EW96K.3.71.G05.1.454.CMB.2.raw
  modified_base (238)..(238): a, c, t, g, unknown or other
  misc_feature (238)..(238): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaagaagcttattangacaagctaggtaccagcaagaacgccgaaggacacggcccctgtactgcatctaatacgtaaaaacaccggcctacgaaggactacccagaccgattcctcctcggctccgagcctaacgaacggaaccacacgtccttaccttacgaaccctactaccgacgttcgggggacctacggaaggggacggaaagtagtaggaacgggctagaacttaacgttaacgtacggttaaacccggtccccggggacctaagaccgtaaggttaacggtaaactagtttacggtagtagttaacggtcggggacggtaaggggaaccttaaagggtcgttacccgtaccgtaacgttaccgacggaccccgtaagggcctcccggcccccgtcggttacctaacccgttccgttaaccccgg

SEQ ID NO: 314162 - DNA, 618 bp, Homo sapiens
  misc_feature: GZ8MTXP01D6YS8.3.71.G05.1.454.CMB.2.raw
  modified_base (312)..(312): a, c, t, g, unknown or other
  misc_feature (312)..(312): n is a, c, g, or t
  modified_base (371)..(371): a, c, t, g, unknown or other
  misc_feature (371)..(371): n is a, c, g, or t
tcagagacgcactccacgaccggtgctcgatttagtgtcgtcgcaagagagaggggggagctctgggagaggagccccagccctgagattcccaggtgtttccattcagtgatcagcactgaacacagaggactcaccatggagttgggactgagctggtattttccttttggctattttaaaaggtgtccggtgtgaagtgcaactggtggagtcgtgggggagcttggtacagcctggcaggtccctgagactctcctgtgcagcctctggattcacctttgatgattatcgccatgcacgtgggtccgnaacgctccgaggggacggctggagtggtctcgaggtattacgtggaatagtgaataacngtcggctagtggacgggtactcgtgtaggaaacgggtccgtaattccgaacctattcctacccgaaaggacgaaccaaaccgacccaaacggggtaaacccttccccgtagtactccgtagacaaatgaaacctgtactagaacgtaacctgggacggacacggtcctttagttaacgtttcgttaggttaacggttaaacggtaacccggggtaaattgttacggttaacgtttaagttttaacgg

SEQ ID NO: 314163 - DNA, 655 bp, Homo sapiens
  misc_feature: GZ8MTXP01A202X.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaagaagctattatgcaagctggaccagcagagccaggacacggcccctgtactgcatctatagtaaaacaccggcctagacggactccagaccgtatcctccgtggctccgagctaacgaaggaaccacacgtccttaccttagaaccctagtccgacgtcggggactcgagggacggaaagagtgggacggtctagtaacttaagttaacgttacggtaaacccggtccccggggacaaggcctaaggttacggtaaactaagtttcggagtacgttaacgttccggggacggggtaaacgggtaacccgaaagggggttcccgaaccccggttacccgttaaccggttccgaaccgggttccccgaaacggggtccctaacccgggtccccccgtcgggttacccctaaccgttcccggtttaaccccg

SEQ ID NO: 314164 - DNA, 660 bp, Homo sapiens
  misc_feature: GZ8MTXP01E304Q.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctacaagaagcttaattatgacaagctaggtaccagcaagaacgccgaggacacggcccctagtacttgtcatactaataacggtaaaaaccacccggccctacgaagggactacccgagaccgtattcctccgtcggctacccgagcctaacgaacgggaaaccacacgtcctttccgttacgaaccctactaccgacgtcgggggcctacggagggacggaaagagtaggacggtcgtagacttaacttacgtacgtaacccgggtcccggacagaccgaaggtagtaactagttagtgtagtacggttcgggacgggaacgggaaccgttaaagggtccggttacccgttacccgttacggaccgaccgaccccggaacggtcccgtaaccccggtcccccgtccgggttacctaacccgttcccgtttccccgg

SEQ ID NO: 314165 - DNA, 573 bp, Homo sapiens
  misc_feature: GZ8MTXP01EKCHG.3.71.G05.1.454.CMB.2.raw
  modified_base (237)..(237): a, c, t, g, unknown or other
  misc_feature (237)..(237): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcagaagctattangcaagctggtaccagcaagaacgccaaggacacggcccctgtacttgtcatctatacggtaaaaacaccggccctcagggatctacacgaccgtattccctctggcctcccagcctacgaaggaaaccacacgtcctttaccttacgaacctatccgaacgtcgggggctacgagggacggaaagagtggagctagaacttaattacgtacgggtaaacccgtcccggggacacgcacggtagtaactagttgtagtatagtcgggaacgggaggacgaaggttcgaccgtcgacgttcacgcccgagcctccgccccttcggtccttcgttcccg

SEQ ID NO: 314166 - DNA, 683 bp, Homo sapiens
  misc_feature: GZ8MTXP01DT24T.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaagaaagctaattatgacaagctggtaaccagacaagaagccaaggacacggcccctgtactgtcatctagtaacggtaaaaacaccggcctacgaaggactacccgacgaccgattcctcctcggctccgacgctaacgaacggaacacacgtccttaccgtacgacctactaccgtacgtcgggggcctacgacgggacggaaagagtcggaacggtcgtacggtaaacttacgttaacgtaccggttaaacccggggtccccggggacgtaacggtccgtaaggttaacggttaactagtttaggtagtaacgttacggttcggggacggggtaaacgggtacccgaaaggggttccgttaacccggttacccgtaacggttaccgaccggaccccgtaacgggtaccctcccggtacccccgtcgggttaccctaaccgttcccgtttaaccccg

SEQ ID NO: 314167 - DNA, 701 bp, Homo sapiens
  misc_feature: GZ8MTXP01B9BGX.3.71.G05.1.454.CMB.2.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaagganacagcctnagaagctatatgcaagctggaccagcaagaagccaggacacggcccctgtactgtcatctaataaggtaaaaaccaccggaccctacgaacggactaccccgagaccgattccgtccctggctcccgagctaaccgaaacgggaaccacgtacgtccctttaccctacgaaccctactaccgaccgtcggggacctacggacgggacggaaagacgtagggaacggcgtacgtaacttaacgttacgttacggttaaacccggtccccggggtaacgaagaccgtaaacggttacggtaaacccgtagtttaggtcgggttaacgttaccggggaacggggtaacgggaaacccgtaaaacgttccgggtaaacccgttaccgtaaacgggtacccgacggaccccgaaacgggtccctaacccggtccccccgttacggtcccttacccgtttcccgttaacccggtttccccccg

SEQ ID NO: 314168 - DNA, 783 bp, Homo sapiens
  misc_feature: GZ8MTXP01BKQ47.3.71.G05.1.454.CMB.2.raw
  modified_base (216)..(216): a, c, t, g, unknown or other
  misc_feature (216)..(216): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagcctcagaagctattatgacaagctaggtaccagcagaacgccaggacacggcccctgtacttgtacatactaataacggtaaaaccaccggtcctacgaaggactacccagaccgtattctccgtcggctaccagtacctaacgaacggaacactacggtccttaccgtacgaacctacgtaccgaacggttcggggacctacggaacggggaccggtaaagggtacgttagggacgggtaccttaggtaaacctttaacgttaaaccgttaccggttaaaccccgggtccccggggtaacccgaacgtaccggttaaaggttacgggttaaaaccgttcggttttacggtacgttaaagttaaccgggtttacccgggggaacgggggtaaaccggggtaaacccgggttaaagggggttacccggttaaaccccgggtttaccccggtaaccgggttacccggaaccggaaccccccgggtaaacgggtccccggttccccggtaaccccccccggttcggggttaacccctaaccccgttccccgggttttaacccccgg

SEQ ID NO: 314169 - DNA, 577 bp, Homo sapiens
  misc_feature: GZ8MTXP01C6VYQ.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctaattatgcaagctggtaccagcagaagccaggacacggcccctgtacttgtcatctaatacggtaaaaaccaccggccctacgaggactcccagaccgattctcctggctcagctaacgaaggaaccacacgtccttacctacgaccatccacgtcggggctacgaggacggaagagtgagctagactatacgtagtaaccgtcccggacaagcaggtacgtaactagttgtagtagttacgtccgggacgggtaacgggaacccgttaaagggtcgaccgtaccgtacgttcgacgaccccgaagggcctccgcccccgtcggttacctaaccgttccgtccccg

SEQ ID NO: 314170 - DNA, 698 bp, Homo sapiens
  misc_feature: GZ8MTXP01DRAZC.3.71.G05.1.454.CMB.2.raw
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctanagaagctattangacagcgtacgacagacaagaacgacgaacggacgaccggtccctagttacttgtactactaacgtaaacgtaaaacggtaaaaaacccgaccccggtacccgtacgaacggtacctacccgaacgtaacccgtacttccgtcccgtcggtacctaccgacgtacccgtaaacgaaacgaaccacgtacgttaccctttaccttacgaacctacgtaccgtacggtcgggactacggacgggacggaaagtagtacggacgtacgtacgtaacttaacgttacgtaaccgtaacccgggtacccgggacgacgtacgtaacggtaacgtaagttagttacgtagtaacgtacggtaccgggacgggtaaacgggtaaccgaagggtaccgttaccgtaccgtacgacgcgacccgaacggtcccgtcccgtccccgtcgttaccctaaccgttcgtcccg

SEQ ID NO: 314171 - DNA, 606 bp, Homo sapiens
  misc_feature: GZ8MTXP01DKNHG.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctcaagaagctaattatgacaagctggtaccagcagaagccaggacacggcccctgtactgtcatctaataacggtaaaaacacccggccctacgaagggactacccgagaccgattcctccgtcggctcagcctaacgaacggaacacagtccttacctgaccatcacgtggggctcgaggacgaaagatgaggctagactattaccgtacgtaaaccggtcccggggaccaggacctaggtacggtaaactagtttggtagtagttacggttccgggacggggtaacgggtaacccgaaaggggttcgaacccgttaccgttaacgcgaccggacccaagggtccctccggcccccgtggttcctaaccgttccgtccccg

SEQ ID NO: 314172 - DNA, 506 bp, Homo sapiens
  misc_feature: GZ8MTXP01DPNKI.3.71.G05.1.454.CMB.2.raw
  modified_base (236)..(236): a, c, t, g, unknown or other
  misc_feature (236)..(236): n is a, c, g, or t
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
  modified_base (385)..(385): a, c, t, g, unknown or other
  misc_feature (385)..(385): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctattangcaagctggtaccagcagaagccaggacaggcccctgtacttgcatctaataggtaaaaacaccggccctnaggactcccagaccgattctctggctccagctacaaggaacncagtcttcctgaccatcacgtgggctcgaggcgaanatgagctagactattactgtaacgtcccgggacagcagtgaacngttgngtatagtcggnggtaaggacaaggtcaccgtctacgttcgagcccaaggctcgcccctggctcgttcgtccg

SEQ ID NO: 314173 - DNA, 500 bp, Homo sapiens
  misc_feature: GZ8MTXP01E0DBN.3.71.G05.1.454.CMB.2.raw
  modified_base (347)..(347): a, c, t, g, unknown or other
  misc_feature (347)..(347): n is a, c, g, or t
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (470)..(470): a, c, t, g, unknown or other
  misc_feature (470)..(470): n is a, c, g, or t
  modified_base (491)..(491): a, c, t, g, unknown or other
  misc_feature (491)..(491): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtactgcatctatggtaaaaacaccggcctcagggactcccagaccgattctcctggctccagctaacaggaacncagccttcctgacccatcacgtgggctcgagggcgaagagtgaggctgactattacngtaacgtcccgggcagcagtgaacnttgnatagtcggnggaaggccaaggtcgaccgtctagttcncgcccaagctcgcccctggcncttcgtccg

SEQ ID NO: 314174 - DNA, 632 bp, Homo sapiens
  misc_feature: GZ8MTXP01CKIGN.3.71.G05.1.454.CMB.2.raw
  modified_base (384)..(384): a, c, t, g, unknown or other
  misc_feature (384)..(384): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggctattttaaaaggtgtccggtgtgaagtgcaactggtggagtcgtgggggagcttggtacagcctggcaggtccctgagactctcctgtgcagcctctggattcaccttgatgattatgccatgcacgtcgggtccggcaagcctaccgagggggaacgggccgtgggaggttgggtctcgtaggttacttacgtaggaattagtagtaaataaccngtcgggtactagtggacggtacttcgtggtagggaaacgggtccgtaacttccaacctactcctaccgaagacgaacaaccgaccaagtaacctcccgtagtaactctacgactaaagtgaaacagtcgtgaacgtacctaggaacggtacgacgggtccttaggtaacttacgttacggttacggttaaacggtaacccggggtaaattaagttaggtacgtttagttttaacggaacttttaaccg

SEQ ID NO: 314175 - DNA, 655 bp, Homo sapiens
  misc_feature: GZ8MTXP01AS3U4.3.71.G05.1.454.CMB.2.raw
  modified_base (257)..(257): a, c, t, g, unknown or other
  misc_feature (257)..(257): n is a, c, g, or t
  modified_base (402)..(402): a, c, t, g, unknown or other
  misc_feature (402)..(402): n is a, c, g, or t
tcagagacgcactccacgaccggtgctcgatttagtgtcgtcgcaagagagaggggctgggagaggagccccagccctgagattcccaggtgtttccattcagtgatcagcactgaacacagaggactcaccatggagttgggactgagcgtggtatttcctttaggctatttaaaaggtgtccgtgtgaagtgcaactggtggagtcgtgggggagcttggtacagcctggcaggtccctgagactctcctgtgcncgcctcgtgtattcactttgatgtattatcgacctatgccgtacggtcgggtccgacaacgccgtaccggagggggacgggtccgtagggaggttcgggtctacgtaggttacttacggttaggtaaagtagtagaaaactaacngtacggactagtcggacggtactcgtaggtacggaacgggtccgtattaccacctactacctaccgagacgaaccaaccgaccgtaaacgtaccttccgtagtactccgtagtactaacgtacgaactacgtacgtacgtacgtacgaggaacggacgaccggtcgttacgttacgttacgttacggttacggttaacggtaaccgggtaacgttaacgttacgttacgttacgtttaacgttaacgttaacg

SEQ ID NO: 314176 - DNA, 651 bp, Homo sapiens
  misc_feature: GZ8MTXP01BEXWJ.3.71.G05.1.454.CMB.2.raw
  modified_base (388)..(388): a, c, t, g, unknown or other
  misc_feature (388)..(388): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggctatttaaaggtgtccggtgtgaagtgcaactggtggagtcgtgggggagcttggtacagcctggcaggtccctgagactctcctgtcgcagcctctggattcaccttgatgattatcgccatgcacgtcgggtccgacaacgctaccggagggggaacgggccgtgggaggttcgggtctacgtagggttacttacggttaggaatagtagtaaataacngtcggacttaagtcggaccgggtactcgtaggtaggaaacggggcctaagttccaaccctattcccgtaccaaggaacgaaccaaacgacccaaagtaaccctcccgtagttactcgtacgaacctaaagtcgaaactacgtccgtagaacgtacccgaggaaggaacccgacgggtaccttagtaactttacgttaggttacggttaaacgggtaacccgggtaaattcggttagttacgttagttttcggaacttttaacg

SEQ ID NO: 314177 - DNA, 649 bp, Homo sapiens
  misc_feature: GZ8MTXP01A0WGS.3.71.G05.1.454.CMB.2.raw
  modified_base (266)..(266): a, c, t, g, unknown or other
  misc_feature (266)..(266): n is a, c, g, or t
  modified_base (397)..(397): a, c, t, g, unknown or other
  misc_feature (397)..(397): n is a, c, g, or t
  modified_base (561)..(561): a, c, t, g, unknown or other
  misc_feature (561)..(561): n is a, c, g, or t
  modified_base (582)..(582): a, c, t, g, unknown or other
  misc_feature (582)..(582): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttattttaaaaggtgtccggtgtgaagtgcaacgtggtggagtcgtgggggagcttggtacagcctggcaggtccctgagactctcctgtgcagcctntggattcactttgatgattatgcctatgcacgtcggggtccgacaacggcgtaccggagggggaacgggccgtggggagttcgggtactcgtagggttaccttacggttaggaaataggtagtaaataacngtcggactagtcggcggtactcgtaggtaggaacggggcctattccgaacctattccctaccgaagacgaaccgaaaccgccaaacgtaccctcccgttagtaactctacgaactaaagtcgaactaaggttcaagggacgacggccggaacggacgccgggtnttagggttattaacgttacgngggttacggccggtaaggggtcggggtcgggttcggtttcgggggttaaccaacgggttaaccccgg

SEQ ID NO: 314178 - DNA, 673 bp, Homo sapiens
  misc_feature: GZ8MTXP01CG8SV.3.71.G05.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (489)..(489): a, c, t, g, unknown or other
  misc_feature (489)..(489): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggccctgctgtgtctgtggccttgggacagacagtcaggatcacatgaccaaaggganacagcctacaagaagcttaattangcaagctaggtacccagacaagaagccaaggacacgcccctgtactgtcatctaataacggtaaaaaccacccggccctacgaacgggtactaccccgaagaccgtattctccgtcggctccagcctaacgaacggtaacacgtacgtccttacctacgaaccctatcgacgtggggactcgaggacggaaagactagggacgactggaacttacgttacgtacggtaaaccggtccccggggaacncgtacgaacggttacggtaaaccttaggtttagtagtaacttacgggttaccggggaacgggtaacggggtaacccgaaagggttccggaacccgttaccggtacgttaccgaccggttaccccgaaacgggtcccgtcccggacccccgttcggttaccctaacccgtttcccgttcccccgg

SEQ ID NO: 314179 - DNA, 571 bp, Homo sapiens
  misc_feature: GZ8MTXP01CRBOV.3.71.G05.1.454.CMB.2.raw
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttggacagacagtcaggatcacatgaccaaaggagacagcctacaagaagctaattatgacaagctaggtaccagacaagaacgccaaggacacggcccctgtacttgtcatctaatacggtaaaaaccaccggcctacgaggactacccagaccgattcctcctcggctcgagctaacgaacgaacacacgtaccttcctacgaaccatccacgtcgggctacgagggacgaagagtgagctagactattacgtacgtaaccgtcccggacagcgtaagtgtaacnttgntatacgtcggacgggaaggaaccaaggtcgaccgtacctacgttacgacgttacccgaaggccctccgcccccgtggttaccaaccgttcgttccccg

SEQ ID NO: 314180 - DNA, 595 bp, Homo sapiens
  misc_feature: GZ8MTXP01BGBIO.3.71.G05.1.454.CMB.2.raw
  modified_base (237)..(237): a, c, t, g, unknown or other
  misc_feature (237)..(237): n is a, c, g, or t
  modified_base (341)..(341): a, c, t, g, unknown or other
  misc_feature (341)..(341): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaagaagctattangcaagctggtaccagcaagaagccaggacacggcccctgtacttgtcatctaataggtaaaaaccacccggccctacgagggactcccaagaccgattcctccnggctccagctaacaaggaacacagtccttcctgaccatcacgtgggctcgaggacgaagagtgaggctagaacttattacgtcgaaccggtcccgggacagaccgaggttacggtaaactgttaggtagtaagttaggttccggggcggggaaacgggaaccgttaaagggtcgttaacccggtccgtaacgttacgacgaccccgaaggccctccggccccccgttgggttaccctaaccgttccgttcccgg

SEQ ID NO: 314181 - DNA, 588 bp, Homo sapiens
  misc_feature: GZ8MTXP01D9Q2K.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctaggaccagcagaagccagacaggcccctgtactgcatctataagtaaaacaccggcctacgaggactcccagaccgattctcctggctcagcctaacaaggaacacacgtaccttacctacgaaccctaatcccacgttcgggggacctacggacggacggaaagagtgaaggctagactattacgtagtaaccgtcccgggacagacgtagtgtaactagttagtcgtagtacgttcgggacgggtaacgggaccgaaagggtcgacccgtaccgtaaccggttcgacggaccccgaagggccctccgtacccccggtcggttcctaacccttccgtaaccccg

SEQ ID NO: 314182 - DNA, 748 bp, Homo sapiens
  misc_feature: GZ8MTXP01CMBM9.3.71.G05.1.454.CMB.2.raw
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttatttaaaaggtgtccggtgtgaagtgcaactggtggagtcgtgggggaggcttggtacagcctggcaggtccctgagactctcctgtgcagcctctggattcacctttgatgattatgccatgcacgtgggtccgcaagctccgaggggaacgggccgtgggagtgggtctcgtaggttacttacgttaggaaagttagtagtaaaattaaacgaagtaccgggtacttagtcggtccgggtaaccttcgtaggtagggaaacggggcccgtaattcgaaccctactacctacccgaaagacgaaaccaaaccgacccaaaacgtaaccccttacccgttacggttaacttacccgttaggaacaaaacgttacggaaaactaacggttacgtaggtaaccgtaaccgttgggaaaccgggtaaccgttacccgggggtacccttttggttaaaaccgtttaagtttacgggttacggttaaaaaaccgggggtttaaccccgggggaaaaaatttaaccggtttaagggtttaaccggtttaagttttttaacggggttaaaaccttttttaacccg

SEQ ID NO: 314183 - DNA, 582 bp, Homo sapiens
  misc_feature: GZ8MTXP01C2F4J.3.71.G05.1.454.CMB.2.raw
  modified_base (372)..(372): a, c, t, g, unknown or other
  misc_feature (372)..(372): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggatttcctttggctattttaaaaggtgtccggtgtgaagtgcaactggtggagtctgggggagcttggtacagcctggcaggtccctgagactctcctgtgcagcctctggattcacctttgatgattatgccatgcacgtcgggtccgcaagctccgaggggaacgggcctgggagtgggtctcgagggttacttacgttggaattagtgaaataacngtcggctatggcggactcgtgtgaagggccgagttcacctatctccaagacgacaacgaccaaagaaccctccgtagtactctagacaaagtgaactacgtctagacgacctggaacggacgacgggtccttagtacgttacgttacgttacggttaaacggtaacccggggtaaataacgtagtacgttattttaacggaactttaacg

SEQ ID NO: 314184 - DNA, 707 bp, Homo sapiens
  misc_feature: GZ8MTXP01C68O3.3.71.G05.1.454.CMB.2.raw
  modified_base (242)..(242): a, c, t, g, unknown or other
  misc_feature (242)..(242): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttggacagacagtcaggatcacatgccaaaggagacagcctacaagaagctaatttacgngacaagcgtacggtaaccagacaagaacgaccgaacggaccgaccggtcccctagttactcgtactatactaagtaaacggtaaaaaccgacccggaccctagacggacctaccgaacgtaccgtacttccgtccgtcggtactaccgacgacctaaacgaaacgaaccacgtacgtccttaccgtacgaacctactacgacggtcgggacacggagggacggaagagtcgacgtcgtagtaacttacgtacgtacggtaaccggcccggacgtaacgtacgtaaggttacgtaacgttagttacggtagtagttacgggtcgggaacgggtaacggtaaccggttacgggtacccggttacccggttacccgtaaccgttaccgaccgggttaccccggtaacgggtccccgttccccggtacccccgttacggttaccccttaacccgttcccgttaaccccg

SEQ ID NO: 314185 - DNA, 574 bp, Homo sapiens
  misc_feature: GZ8MTXP01C1197.3.71.G05.1.454.CMB.2.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (472)..(472): a, c, t, g, unknown or other
  misc_feature (472)..(472): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagccctnaagaagctaattangcaagctggtaccagcagaagccaggacacggcccctgtacttgtcatctaatacggtaaaaaccaccggccctacgagggactcccgaagaccgattccgtccgtcggctccagcctaacaaggaacacagtccttacctagacccatccgacgttcggggctacgaggacggaaagagtaggaggctagaactagtactacgtaaccgtcccgggcaagcagtgtaacngttgtgtagtagtcgggcggtaagggaccttaaggtcgaccgtacctacgttacgcgttacccgaaggccctcgcccccgtgttcctaaccgttcgttcccg

SEQ ID NO: 314186 - DNA, 551 bp, Homo sapiens
  misc_feature: GZ8MTXP01CVR33.3.71.G05.1.454.CMB.2.raw
  modified_base (367)..(367): a, c, t, g, unknown or other
  misc_feature (367)..(367): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttcctttggctattttaaaaggtgtccggtgtgaagtgcaactggtggagtcgtgggggaggcttggtacagcctggcaggtccctgagactctcctgtgcagcctctggattcacctttgatgattatgccatgcacgtgggtccgcaagctccgagggacgggctgggagtgggtctcgaggtacttacgtggaatagtgaaataacntcggactatgcgactcgtgtagaagggccgattcaccatctccagagacaacgaccaagaacctcctagtatctagacaaatcgaacagtctagagacctggaacggacacggtccttgtattacttaggttagttaaacggtcccggggaaataagtgtacgttattttaaggaactttaacg

SEQ ID NO: 314187 - DNA, 594 bp, Homo sapiens
  misc_feature: GZ8MTXP01APVP3.3.71.G05.1.454.CMB.2.raw
  modified_base (375)..(375): a, c, t, g, unknown or other
  misc_feature (375)..(375): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttccttttggctattttaaaaggtgtccggtgtgaagtgcaactggtggagtcgtgggggaggcttggtacagcctggcaggtccctgagactctcctgtgcagcctctggattcactttgatgattatgccatgcacgtcggggtccgcaagctaccgagggggaacgggcctgggagtgggtctcgaggtacttacgtggaatagtgaaataacntcggctagtcgcgggtacctgtaggtgaacgggccgtattccaccaatcctaccgagacgaacaacgaccaaagaacctcccgtagtactcagactaaagtcgaaactagtacctgacgacctggaacggacttacgggtccttagtacttacgttggttacgttaaaccgggtccggggtaaatcgtacggtacgttattttaacgggaactttaacg

SEQ ID NO: 314188 - DNA, 612 bp, Homo sapiens
  misc_feature: GZ8MTXP01DALWW.3.71.G05.1.454.CMB.2.raw
  modified_base (354)..(354): a, c, t, g, unknown or other
  misc_feature (354)..(354): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtgccttgggacagacagtcaggatcacatgccaaggagacagcctcagaagctaattatgcaagctggtaccagcagaagccaggacacggcccctgtactgtcatctaataggtaaaacaccggccctcagggactacccgagaccgattctcctggctcagctaacaggaaccanacgccttcctgaaccatcctacgtggggacctcgagggacgtaagatgaaggctaggactattacgtcgtaaacgtcccgggacagcgtagtacgtaactagttggtagtaacgttagtccggggacggtaaacggggtaacccttaaaggggtccgaaaccccgttacccgtaacggttaccgaccgggttaccccgaaagggtcccgtaaccggtcccccccgtgggttaccctaacggttccctttaacccccgg

SEQ ID NO: 314189 - DNA, 608 bp, Homo sapiens
  misc_feature: GZ8MTXP01BNLVH.3.71.G05.1.454.CMB.2.raw
  modified_base (216)..(216): a, c, t, g, unknown or other
  misc_feature (216)..(216): n is a, c, g, or t
  modified_base (320)..(320): a, c, t, g, unknown or other
  misc_feature (320)..(320): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagcctcagaagctatatgcaagctggaccaaacaaagccaggccaggccctgtggtggtgatataataaagacagtgagacggccctagagggacttcccgnggacgtcgtactttctcgtggcctccgaaagcctaacgacgggtaaacaaacgagttaccgacgttacgaacctagtaccgaggtacggacgtcccgaagggaccaagggagacggaagcgtacgtacgtaattagttagtacgtagtacgaacgacgaacgaacaactaacgtaattaacttaacttacttaacttacgttacgttacgttacgtacgtacggttacggttacggttaccgtaaccgtacgtaacgtacgtacgaccgtaaccgaacccgtaacccg

SEQ ID NO: 314190 - DNA, 785 bp, Homo sapiens
  misc_feature: GZ8MTXP01CX3V9.3.71.G05.1.454.CMB.2.raw
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctacaagaagtctaattancgacaagtcgtacggtaaccagacgaagaacgccgaaggacacggcccctagtacttgtcatactaagtaacggtaaaaaccacccggcctacgaacggacctaccgaacgtaccgtattccgtacccgtcggtacctaccgacgtacctaaaccgaaacgggaaacctaccgtaaacgttccctttacccgttacggaaaccctacgtaccgtaaccgggttcggggacctaacggacgggaccggaaaggtacgtacgggacggtacgtacgtaaacgttaacgtttaaaccgtaccggttaaacccggggtccccggggaaccgtaacggtaaccggtaaagggttaacggttaaaccgttagtttaacgggtaaggttaaacgttacgggttaccgggggaacggggtaaacggggtaaaccggttaacggggttacccgaacccggtttaacccgtaccgggttaaccgaccggaccccgtaacgggtccctcccggtacccccggtcggttaaccctcccgtttcccgtttaaccccg

SEQ ID NO: 314191 - DNA, 644 bp, Homo sapiens
  misc_feature: GZ8MTXP01CAA0I.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaaaggacgacagcctacgaagaacgtcttaattatgacaagctaggtaccagcaagaacgccgaaggacacggcccctagtacttgtacatactagtaacggtaaaaaaccacccggtcctacgaacgggactacccgagaccgtattctaccgtcggctccgacgctaacgaacggaaccacacgtccttacctacgaccatccacggtcgggactcgagggacgtaagagtacggaggtctacggaacttaagttacgtacgtaaccgggtcccggactacgacgtaagtacggtaactagttacgtagtaagttacggttcggggacgggtaaacgggaaccgttaagggtcgaccggttacctacgacgttaccgacccgaaggccctccggacccccgtggttaccctaaccgttccgttaaccccg

SEQ ID NO: 314192 - DNA, 633 bp, Homo sapiens
  misc_feature: GZ8MTXP01BK2BP.3.71.G05.1.454.CMB.2.raw
  modified_base (266)..(266): a, c, t, g, unknown or other
  misc_feature (266)..(266): n is a, c, g, or t
  modified_base (376)..(376): a, c, t, g, unknown or other
  misc_feature (376)..(376): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttattttaaaaggtgtccggtgtgaagtgcaactggtggagtcgtgggggaggcttggtacagcctggcaggtccctgagactctcctgtgcagcctntggattcacctttgatgattatgccatgcacgtcgggtccgcaagcgtccgagggggacgggccgtgggagtggtctcgtaggttacttacgttggaatagtgaataacngtcgctagtcggcggtactcgtgtggaagggccgtattcaccatacctaccgaagacgaacaaccgaccaaacgtaaccctcccgtagttactccgtagaactaaacgtcgaaactagtctaggaacgtacccgtaggaacggaaccgttaccgggttccctttagttaacgtttacgttaggttaggttaaaccgggtaacccggggtaaattaacgttaggttaacgttagtttttaacggttaacttttaaccg

SEQ ID NO: 314193 - DNA, 679 bp, Homo sapiens
  misc_feature: GZ8MTXP01B777A.3.71.G05.1.454.CMB.2.raw
  modified_base (374)..(374): a, c, t, g, unknown or other
  misc_feature (374)..(374): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttatttaaaggtgtccggtgtgaagtgcaactggtggagtcgtgggggagcttggtacagcctggcaggtccctgagactctcctgtgcagcctctgtattcacttgatgtattatcgccatgcacgtcgggtccgcaacgctacgagggacgggccgtggagtggtctcgtaggttacttacgtaggaatagtgtaaactaacgngtcggtacttagtcggccgggtacttcgtagggtacggaacgggtccgtacttccaaccgtacttacccgtacccgaaggaaccgaaccgaaaccgaacccgtaaacggtaaccccttaccccggttaggttaacttaccgtaacggtaaacctaaaagttaccggaaacgtacggttacccgtaggaaccgtaccgtagggaaaccggtaccgttaccggttaccttagttaacttacgttaggttacggttaaacgggtaaccgggtaattgttagtacgttagtttaacgttaatttaaccg

SEQ ID NO: 314194 - DNA, 718 bp, Homo sapiens
  misc_feature: GZ8MTXP01DWY9M.3.71.G05.1.454.CMB.2.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagcctnaagaagctaattangcaagctggaccagcagaagccaaggacacggcccctgtactgcatctaagtaacggtaaaaaccaccggtccctacgaagggacctacccgaacgaaccgtatttcctaccgtcgggacctaccgacgtcctaaaccgaaacgggaaaccactaacggtaccctttacccgttacgaaccctagttacccgaacggttcgggggaccttacggaacggggaccggtaaagacgttagggaacggtcgtacggtaaactttacgttaaaccgttaccgggttaaacccgggtcccccggggaccgtaaggaccgtaacggttacggtaaacctagtttacggtagtaacgttacggttccggggacgggaaacgggtaaccgttaaggggtaccgacccgttaccgtaacggttaccgacggaccccgaaggtcccgtccggtcccccgtcgggttacctaacccgttccgttaaccccg

SEQ ID NO: 314195 - DNA, 688 bp, Homo sapiens
  misc_feature: GZ8MTXP01EMI2B.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcaagaagctattatgacaagctaggtaccagcaagaacgccgaaggacacggcccctgtacttgcatctaataacggtaaaaaccaccggcctacgagggactacccgagaccgattcctccgtacggcctaccagcctaacgaaacgggaaccacgtaacgtccctttacccttacggaaccctagttacccgtaaccggttgggggaccctacgggaacgggaccgggaaaagtacgttacgggaagggtcctaggtaaccttaaagttaaccgtacgttaaaccggggttccccggggaactacggaccgtaaggtacggtaactagtttacgtagtattaacggttcgggacgggaaacgggtaaccgttaaagggtccgttacccgtccgttaaccggcgacggaccccgaaagggtccttcccgcccccgttcggttcctaaccttccggtttccccg

SEQ ID NO: 314196 - DNA, 652 bp, Homo sapiens
  misc_feature: GZ8MTXP01BRZX5.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacaagaagtctaattatgacaagcgtaggtaaccagacaaggaacgccaaggacacggcccctgtactcgtcatactaagtacgtaaaaaccacccggccctacgaacgggactacccgacgaccgtacttcctccgtcggctccagcctaacgaacggaacactacgtccttcctacgaacctataccacgtggggactcggacgggacggaagagtggacggctgaacttagttacgtacggtaacccggtcccgggacagcgtaaggtacggtaactagttcgtagtaacgttacggtcggggacggggaacggtaaccggaagggtaccggttacccgttacccgtaacggttaccgaccggttaccccgaagggtccctcccggtcccccgttcggttacctaaccgtttcccgttccccggg

SEQ ID NO: 314197 - DNA, 571 bp, Homo sapiens
  misc_feature: GZ8MTXP01CJ8W3.3.71.G05.1.454.CMB.2.raw
  modified_base (204)..(204): a, c, t, g, unknown or other
  misc_feature (204)..(204): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (338)..(338): a, c, t, g, unknown or other
  misc_feature (338)..(338): n is a, c, g, or t
  modified_base (409)..(409): a, c, t, g, unknown or other
  misc_feature (409)..(409): n is a, c, g, or t
tcagagacgcactccacgaccggtgctcgatttagtgtcgtcgcaagagagagggggcagaagcagagttctggggtgtctccaccatggcctggaccccctctggctcactctcctcactctttgcataggttctgtggtttcttctgagctgactcaggaccctgctgtgtctgtggccttgggacagacagtcaggatcanatgaccaaggagacagcctnaagaagtcttaattangacaagctggtaccagacagaagccaggacacggcccctgtactgtcatctatagtaaaacaccgcctacagggactccagaccgtattctctccggntacccccagctacgaaacggaaacaacacgtaccttccttacgaccactcacgtgggctcgaggacgaagngtagagctagacttactacgtcgtaaccgtccggggcacgcgtaagtgtaactgttgtagtatagtcggcggaggtaaccgtaaggttcgaccgttcgtacgtacgaccgccgttacggtccgtccgtccccgtcggtaccttccttccgttccgttccccg

SEQ ID NO: 314198 - DNA, 605 bp, Homo sapiens
  misc_feature: GZ8MTXP01B0M16.3.71.G05.1.454.CMB.2.raw
  modified_base (306)..(306): a, c, t, g, unknown or other
  misc_feature (306)..(306): n is a, c, g, or t
  modified_base (371)..(371): a, c, t, g, unknown or other
  misc_feature (371)..(371): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttattttaaaaggtgtccggtgtgaagtgcaactggtggagtcgtgggggagcttggtacagcctggcaggtccctgagactctcctgtgcagcctctggattcacctttgatgattatgccatgcacgtcggtccgnaagctccgaggggaacggccgtggagtgggtctcgaggttattacgtaggaatagtgaaataacngtcgggactagtcgcggactcgtgtaggaacgggccgtatcaaccatcctaccagacgaacaaccgaccaaacgaaccctcccgtagtactctacgaacaaatacgaacacgtctagaacgacctggaacgggaaccacgggtacccttgttaaacgttaccgttagttacggttaaaacggtaacccggggaaattaacgttgtaacgttagttttaacggaaccgtttaacg

SEQ ID NO: 314199 - DNA, 629 bp, Homo sapiens
  misc_feature: GZ8MTXP01CMG5N.3.71.G05.1.454.CMB.2.raw
  modified_base (237)..(237): a, c, t, g, unknown or other
  misc_feature (237)..(237): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctattangcaagctggtaccagcaagaagccaggacacggcccctgtactgtcatctatacggtaaaacaccggcctacgaggactccagaccgtattcctccgtcggctccgagtcctaacgaacggaacacaacgtcctttaccgtacgaacctatccgacgttcggggacctacggagggtacggaaagagtagggaggtctagtaacttagttaaccgtacgtaaacccggtcccgggacagtacgagtacggtaactagtttgtagtataacggttcggggcgggaaacgggtaccgaaagggtccgacccggttaccgtacggttaccgacggaccccggtaaaggccccgttccgtccccccgttggttaccctccgttcccgtttccccgg

SEQ ID NO: 314200 - DNA, 625 bp, Homo sapiens
  misc_feature: GZ8MTXP01DE9AZ.3.71.G05.1.454.CMB.2.raw
  modified_base (425)..(425): a, c, t, g, unknown or other
  misc_feature (425)..(425): n is a, c, g, or t
  modified_base (462)..(462): a, c, t, g, unknown or other
  misc_feature (462)..(462): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgtacaaggagacagcctcaagaagctaattatgacaagctggtaccagcaagaagccaggacacggcccctgtacttgtctatttagtaggtaaagaacttaccggccctacgaagggactacccgacgaaccgatctccgtcggctcagcctaacgaacggaacacacgtccttacctcgaacctatcgacgtggggctacggagggacgaaagagngaggctagactattacgtcgacggccgtaccgggaanaaccgtagtacgtaactagttacggtaggttacgtacgggaccgggtaaggaaaccctaaacggttcggtacccggttacgttacgggccaaccggttcccgaacggtcccgtcccgcccccgtttcggacccttaccgttcccgttccgtttaacccccccg

SEQ ID NO: 314201 - DNA, 637 bp, Homo sapiens
  misc_feature: GZ8MTXP01AQG05.3.71.G05.1.454.CMB.2.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctanaagaatctattangcaagctaggtaccagcagacgccagacacgccctgtactgcatactataacggaaaaccaccggcctagacggactcccaagacctattctccgtacggctaccgacgtactaaccgaacggtaaccacgtacgttccctttacccgtagaacccctagtacccgtacggtacggggtcctacggacggggtacggaaaggtacgtagggaggtcctaagtaacttacgttaccgtacgtaacccggggtcccggggacacgacgtaggttacgaacgtagttagtacgtagttacggtcggggacgggaacgggtaacgacgggtccgacccgttcgtaacgcgttaccgcccgaacggtccgtccgccccgtcggacctccgttcgttaaccccg

SEQ ID NO: 314202 - DNA, 721 bp, Homo sapiens
  misc_feature: GZ8MTXP01CIX1V.3.71.G05.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaagganacagcctacaagaagtctaattangacaagctaggtaccagcaagaagccaggacacggcccctgtactgtcatactataacggtaaaaaccacccggccctacgaaggactacccgagaccgattcctccgtcggctccgagctaaccgaaggaaccacgtacgtcctttacctcgacctactaccgtacgtcggggcctacggacgggaccggaagagtaggacggtccgtaggtaacttaagttaccgtaacggtaacccgggtccccggggactacggacgtaacggttcgtaaaccgtagtttggtagtaacgttaacgggttccggggacgggggtaaaccggggtaaccgttaaacgggggttacccggttaaccccgggtttacccgtaaccgggttacccgaccgggaaccccccgtaaacggggtccccgttcccccggtacccccccgggttccgggttaacccctccccgtttcccgtttaacccccccgg

SEQ ID NO: 314203 - DNA, 620 bp, Homo sapiens
  misc_feature: GZ8MTXP01EDFPX.3.71.G05.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaagganacagcctcaagaagtctaattagngacaagctaggtaccagacaagaacgcgaggacacggcccctgtacttgtacatactaagtaacggtaaaaaccaccccggtccctacgaacggacctacccgaacgaccgtattctccgtcggctacacgctaacgaacgaacactacgtccttcctacgacctactccgacgtcgggactcgaggacggaagagtagacggctagacttagttacgtacgtaacccggtccgggactaacgacgtaggtagtaactagttacgtagtagttacggttcgggacggtaacgggaccgttaagggtcgttaccgtccgtacgaccgacgacccgaaggtcccgtccgccccgtcgttacctaaccgttccgttccccg

SEQ ID NO: 314204 - DNA, 691 bp, Homo sapiens
  misc_feature: GZ8MTXP01BRQSH.3.71.G05.1.454.CMB.2.raw
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
tcagagacgcactccacgaccggtgctcgatttagtgtcgtcgcaagagagagggggcagaagcagagttctggggtgtctccaccatggcctggacccctctctggctcactctcctcactcttgcataggttctgtggtttcttctgagctgactcaggaccctgctgtgtctgtggccttgggacagacagtcaggatcacatgccaagganacagcctacaagaagctattangacaagctaggacagcagacgcaggacacggccctgtactgcatctaagtaacggtaaaaaccacccggcctacgaacgggtacctacccgacgtaccgtacttcctccgtcggtacctccgacgtcctaacgaaacggaaccactaccgttccctttaccctacggaacctacgtaccgacggtacgggtcctacgggacgggacggaagtacggtggacggtcgtacgtaacttaacgttacggtaacccgtaaccgggggtcccggtacgacgtacgtaggttacggtaactagtttagtacgtaagttacggtacggggacggggtaacgggtaaccggttaaacgggtccggttaacccgtaccggtaccgacccggccggaccccgaacgggtcccctccccggttacccccgtcgggttaccctaacccgtttcccgttaacccccg

SEQ ID NO: 314205 - DNA, 712 bp, Homo sapiens
  misc_feature: GZ8MTXP01DKB7X.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttggacagacagtcaggatcacatgaccaaaggagaacagcctacaagaagcttaattatgacaagctacggtaaccagacaagaacgccaaggacacggcccctagtacttgtcatactaagtaacggtaaaaaccacccggccctacgacggacctacccgaacgaccgtattcctaccgcggacctccgacgctaacgaaggaaccacacgtccttacctacgacctactccgacgtcggggacctacggacgggacggaaagagtaggacggtactacggtaacttacgttaaccgttaccggtaaaccccgggttacccccggggacccgtaacggtacccgtaaggttaaccgggtaaacgtgtttacggtagtaacgttacggttaccggggaacggggtaacgggaaccgttaacgggtaccggttaccccgttaccggttaccggaccgaccggaaccccggtaacggtcccgtaacccggtcccccgttcgggttaccctaaccgttcccgtttccccgg

SEQ ID NO: 314206 - DNA, 620 bp, Homo sapiens
  misc_feature: GZ8MTXP01AE027.3.71.G05.1.454.CMB.2.raw
  modified_base (236)..(236): a, c, t, g, unknown or other
  misc_feature (236)..(236): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattangacaagctaggtacagcaagacgcaggacacggcccctagtactgtacatctaagtacggtaaaacaccggcctacgaggactccacgaccgtattcncctggctccgagctaacaacggaacncacgtcttacgtacgaccatccacgtggggcctacgagggacggaagagtaggacgtctagacttagttactacggtaaccggtcccgggacagaccgagttacgtaactagttacgtagtatacggttaccgggacgggtaacgggaaccgttaacggggtccggttaaaccggtcccgtaacggttccgaacggttaccccgtaagggtcccttaaccgggccccccttcgggttaccctaaccgttcccgttccccg

SEQ ID NO: 314207 - DNA, 640 bp, Homo sapiens
  misc_feature: GZ8MTXP01CG0M1.3.71.G05.1.454.CMB.2.raw
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (362)..(362): a, c, t, g, unknown or other
  misc_feature (362)..(362): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctcagaanctattangcaagctggtaccagcaagaagccaggacacggcccctgtactgtacatactaataacggtaaaaaccacccgggtccctacgaacgggactccccgaagaccgtattctccgtcggctccganctaacaaacggaacacacgcctttactacgaacctatccgacgtggggacctcggacgggacggaagtagtggacgggtctaggtaacttaacgttacgtacggttaaacccggccccggggtaccacggaccgtaaggttcggtaaactgtttacggtaggtaacttaggttcgggacgggaacgggtaacccgttagggtccgttaacccggtccgtacgttacgaccgacccggaagtcccgtccgtcccccgtggttcctaacgttccgtcccg

SEQ ID NO: 314208 - DNA, 706 bp, Homo sapiens
  misc_feature: GZ8MTXP01DLKLK.3.71.G05.1.454.CMB.2.raw
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttcctttggctattttaaaggtgtccggtgtgaagtgcaactggtggagtcgtgggggagtcgttggtacagccgtggcaggtccctgacgactctcctgtgcacgcctcgtggtacttctacctttgacttgtatttatcgacctagtcgtaccgtacggttcgggggtaccccggactaaacggccgtacccgggaagggggaacgggtccgtagggtaggtggggtacctacgtaggttaagttacgttaggaataagtagtaactaaacgtacggtcgtactaagtcggtacgggtactcgttaggtacgggtaacgggaccgtatttacccgaacctacgttacctaccgaacgaacgaaaccgaaacccgaacccgaaacggtaaaccccttccgttagtactaccgtacgaataaacgtagaacgtagtacgtagaacgtaacgtaggacggtaccacggttcgttagttacgttacgttaggtaacggttaaacgtaaccggggtaatacgttaggttaacgttaagttttaaccg

SEQ ID NO: 314209 - DNA, 654 bp, Homo sapiens
  misc_feature: GZ8MTXP01DY8HW.3.71.G05.1.454.CMB.2.raw
  modified_base (244)..(244): a, c, t, g, unknown or other
  misc_feature (244)..(244): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatcgaccaaaggagacagcctacaagaagtcttattangacaagcgtaggtaccagacaagaacgccgaaggacacggtcccctgtacttgactatactaagtaaacggtaaaaaccgacccggtcctacgaacgggactacccgaacgaccgtattccgtacgtcggcctaccgagcctaacgaacggaacactacgtccctttacgtacgacctatccgacggtggggactacggagggacgaagtagtgagctagtactattacgtacgtaaccgcgggaccagacgtaggtaacgtactagttaggtataagttacggtcgggacggggtaacggtaacccgaagggttccgttacccggtaccgtaccggttacgaccggaccccgtaagggtccctaacccgggtcccccgttgttaccctaacccttcccgttaacccccg

SEQ ID NO: 314210 - DNA, 612 bp, Homo sapiens
  misc_feature: GZ8MTXP01DKLLX.3.71.G05.1.454.CMB.2.raw
  modified_base (239)..(239): a, c, t, g, unknown or other
  misc_feature (239)..(239): n is a, c, g, or t
  modified_base (342)..(342): a, c, t, g, unknown or other
  misc_feature (342)..(342): n is a, c, g, or t
tcagagacgcactccacgaccggtgctcgatttagtgtcgtcgcaagagagagggggcagaagcagagttctggggtgtctccaccatggcctggacacctctctggctcactctcctcactctttgcataggttctgtggtttcttctgagctgactcaggaccctgctgtgtctgtggccttgggacagacagtcaggatcacatgaccaaaggagacagcctcaagaagctattangcaagctaggtaccagcagaacgccaaggacacggcccctgtacttgtcatctaatacgtaaaaaccacccggccctacgaggactacccagaccgacttccnctacggctccagcctacgaacggaaacacacgtccttacctagaccatccgacgtcggggctacgagggacggaagactggacggctagaacttattaccgtaggggtaaccccgtcccggggacacggctagtacgtaacgtattcgtagtatacggttcgggaacgggaacgggaaccgtaagggttcgtaacccggttccgttaccggttcgaaccggcccgaagggtcccgttcccgacccccgttcggtaaccaaccgtttcccg

SEQ ID NO: 314211 - DNA, 646 bp, Homo sapiens
  misc_feature: GZ8MTXP01B9LAH.3.71.G05.1.454.CMB.2.raw
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaagganacagccctanaagaagtcttaattatgacaagcgtaggtaaccagacaagaacgccgaaggaccacggcccctagtactgtacatactaacgtaaacggtaaaaaccacccggtcctagaacggactacccgagaccgtattccgtccgtcggctccgagacctaacgaaacggtaaccacgtaccgtcctttaccgtacgaaccctacgtccgacgtcgggacctacgacgggtacgaaagagtacggacgtctacgtacttaagttaccgtaccgtaaccggggtcccggacacgtacgtaggtacgtaatagttagtagtagtacggtacgggacgggtaacggacgttagggtccgttaccgtacgtacgttaccgacgacccgaagcccgtccgccccgtggttcctaaccgttccgtccccg

SEQ ID NO: 314212 - DNA, 642 bp, Homo sapiens
  misc_feature: GZ8MTXP01AZOQX.3.71.G05.1.454.CMB.2.raw
  modified_base (562)..(562): a, c, t, g, unknown or other
  misc_feature (562)..(562): n is a, c, g, or t
  modified_base (611)..(611): a, c, t, g, unknown or other
  misc_feature (611)..(611): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaaggacgacagcctacgaagaagtctattatcgacgaagcgtaggtaccagacgaagaacgccgaaggaccgacgcccctagtactgacatacgtaagtaacggtaaaaaccacccggtcctacgacgggtacctacccgaacgtaccgtacttccgtacccgtcggtacctaccgacgtaccctaaacgaaacggaaccacgtaccgttaccctttaccgtacggaacctacgtaccgacggtcggggacctacgggaggtacggaatagtacggagctagtacttaagttacgtacgtaaccgggtccggacagacgtaagtacgtaatgttgacgtagtacgtcggnggaacggacgaggtcgaccgttcgtacgttaccgcgaccgtaacgtccncccgtacccgcgttacctcgttccgttcccg

SEQ ID NO: 314213 - DNA, 647 bp, Homo sapiens
  misc_feature: GZ8MTXP01A97KM.3.71.G05.1.454.CMB.2.raw
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
tcagagacgcactccacgaccggtgctcgatttagtgtcgtcgcaagagagaggggcagaagcagagttctgggtgtctccaccatggcctggacccctctctggctcactctcctcactctttgcattaggttctgttggtttcttctgagctgactcaggaccctgctgtgtctgtggccttgggacagacagtcaggatcacatgaccaaagganacagcctcgaagaacgtcttaattangacaagctaggaccagacagaacgccaggacacggcccctagtactgctatactaagtaacgaaaacaccggcctacgaaggacctaccgaacgtacctacttctccgtacggctaccgacgactaaacgaaacgaaccactacgtacccttaccgtacgaacccataccgtacggtcgggactacggacggacggaagtagtacggagtactagtaacttacgttacgtaccgtaccgggtaccggtacgacgtacgtacgtaacgtaacgtagttacggtacgtaagttacggtacgggacgggtaacggaacgttacgggtaccgacccgttacgtacgacgaccgacccgtaacggtccgtaacccgtcccggtcgttccgtaacccttcgtaaccccg

SEQ ID NO: 314214 - DNA, 653 bp, Homo sapiens
  misc_feature: GZ8MTXP01B6XA2.3.71.G05.1.454.CMB.2.raw
  modified_base (537)..(537): a, c, t, g, unknown or other
  misc_feature (537)..(537): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcgaagaagcttaattatgacaagctggtaccagcaagaacgccaggacacggcccctagtacttgtcactactaagtaacggtaaaaaccacccggccctacgaacgggactacccgaacgaccgtattcctaccgtcggctcgacgctaacgaaacggaacactacgtcctttccgtacgaccacgtccgacgtcgggggacctacgacgggacggaagagtcggaggtctagtacttacttacgtacgtaaccggtcccgggacagcgtacggtacgtaaacgtgttaggtacgtacgttacggtcggggngggtaacgggaaccgttaaacgggtccggaaaccgttccgtaacggttccgacgacccggtaacggtcccgtcccggcccccgttcgggttaccctaaccgttcccgttaaccccg

SEQ ID NO: 314215 - DNA, 599 bp, Homo sapiens
  misc_feature: GZ8MTXP01ALUF9.3.71.G05.1.454.CMB.2.raw
  modified_base (236)..(236): a, c, t, g, unknown or other
  misc_feature (236)..(236): n is a, c, g, or t
  modified_base (359)..(359): a, c, t, g, unknown or other
  misc_feature (359)..(359): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattangcaagctggtaccagcagaagccaggacacggcccctgtacttgtcatctaatacggtaaaaaccacccggccctacgagggactcccgagaccgattctcctggctccagctacaacgaacncacgtcttcctgaccatcacgtgggctcgaggcgaagagtggagctagacttagttacgtacggtaaccggtccccggggactagaccgtaggtacggtaaactagtttaggtagtaagttacggttcggggacgggaacgggaacccgttaagggtccgacccgttccgtaacgttccgaacggccccgaacgggtccctcccggcccccgtcggttaccctaaccgttccgttccccg

SEQ ID NO: 314216 - DNA, 682 bp, Homo sapiens
  misc_feature: GZ8MTXP01ARJFD.3.71.G05.1.454.CMB.2.raw
  modified_base (290)..(290): a, c, t, g, unknown or other
  misc_feature (290)..(290): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttaattttaaaaggtgtccggtgtgaagtgcaactggtggagtcgtgggggagcttggtacagcctggcaggtccctgagactctcctgtgcacgcctctggtacttcactttgatgattangccatgcacgtcgggtccgacaacgccgtaccggaagggggaacgggccgtaggggaggttcgggtctacgtaggttacttacgttaggtaaattaggtagtaaaactaacgtaagttcgggacttagtcggtacggtacttcgtagggtacggaacggggtcctaacttccaacctacttacccgaccaagacgaaccgaaccgaccaaagtaccctccgtagttactctagaacctaaagtacgaaacgtacgtccgtaggaacgtaccctagggaacggtaccgttacgggtccttaggttaacgttacgttaggttaacgggttaaaaccgggtaacccggggtaaatcggttagtaacgtttagttttaacggttaacttttaaccg

SEQ ID NO: 314217 - DNA, 651 bp, Homo sapiens
  misc_feature: GZ8MTXP01CP7LJ.3.71.G05.1.454.CMB.2.raw
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctacaagaanctattangacaagctagtaaccaaacaaacgccgacggccacggccctggtggtgtagatataataaagacagtagacgacgacccgtagaggactcccgtagacgacgtacttctcgtcggcctaccgaacgcctcggaacgggaaccaaacgtacgtaccgtaacgttacgaaccctagtcgaggttacggacgtaccgaagggacgaacgggacggtaacggaggactaaggtaactttagtttacgttacgtaataacgtacgaacgacgaaacgaaactaaaacgtaattaaactttaactttacgttactttaagtacgttcgttacggttagttaccggtacgggttaaccgttcgggttccctaaccggtcgtaacggacctaccgacccgaacggttaaccccaaccccg

SEQ ID NO: 314218 - DNA, 816 bp, Homo sapiens
  misc_feature: GZ8MTXP01CJXX0.3.71.G05.1.454.CMB.2.raw
  modified_base (373)..(373): a, c, t, g, unknown or other
  misc_feature (373)..(373): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttctctgagctgactcaggaccctgctgtgtctgtggccttggacagacagtcaggatcacatgaccaaaggagacagacctacaaggaagtcttattaatgactaaggctacggtaaccagacgaagaacgtccgaaggaccgacggtcccctagttactagtactagttacaagttaaacggaaaaaccgcccggacctagaacggacctacccgaacgtaaacccgtnttccgtacgttccggactaccgtagacctaaaccgaaacggaaaccctacgtacgttaccctttaccgtaacgaaccctagtacccggtacgggtaccgggtaccgtaacgggaacggggaaacggtaaggtaacggtacgggtaaccggtacgtaaacgtaaaccgtttaacgttaaccggtaacccggtaacccggggtaccccggggaactaccggtaacggttaacgggttaacgtaacgttaggtttacggtaacgttaacggttaccggggtaccggggaaccggggtaaacgggtaaccggttaaccgggttacccgttaaacccggtttaccgtaaccggacccggttaaccggaaccccggtaaccggtccccgttaaccccggttacccccggttcgttaaccctttaacccgttaaccccggtttaaccccg

SEQ ID NO: 314219 - DNA, 643 bp, Homo sapiens
  misc_feature: GZ8MTXP01BOO1J.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaaggagacagcctacaagaagctaattatgacaagctaggaccagacagaacgccgagacacggcccctgtactgtcatactataacggaaaaacaccggcctacgacggtactacccgaagaccgtattccgtacctcggacctaccgacgtcctaacgaaacggaacactaacgtccttacctacgacctataccgacgtcgggctacgacgggacggaagagtcggaagctagactaacgttacgtacgtaaaccggtcccggacctagtaccgtaaggttacgtaaacgtagtttacggagtagttacgttcgggaacggggaacgggtaccgttaaagggtcgacccggttaccgtaaccgttacgcttaccccggaaggtcccgtccgtccccgtacggttacctaaccgttccttaaccccgg

SEQ ID NO: 314220 - DNA, 734 bp, Homo sapiens
  misc_feature: GZ8MTXP01EA7AN.3.71.G05.1.454.CMB.2.raw
  modified_base (217)..(217): a, c, t, g, unknown or other
  misc_feature (217)..(217): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttctctgagctgactcaggaccctgctgtgtctgtggccttgggacagacagtcaggatcacatcgaccaagganacagcctacaagaagcttaattatgacaagcgtaggtaacccagacaaggaacgccgaaggacacggcccctagtacttgtcatactaacgtaacggtaaaaaccacccggtccctagaacgggtactaccggacaaccggaccgtactttcccgtcgtcggtaccctaccgacgtacctaacggaacggaacctaccgtacgttccccttacgttacgaacctacgtccgacgggtacgggccgtacggaacggggaaccgtaagtacgtacgggaacgtcgttaacgtaaccgttatttacccgttaccgggtaaccccggtcccggacgtagtacccgtaggtacgtaacgttaggttcggtacttaacggtaccgggtacggggaaccgggtaagggttaacccggtaaccgggttaccgtacccggttacccggttaaccgttccggacccggtaaccccgtacgtcccgttacccccggcccggttcctaacccgttaacccgtttccccg

SEQ ID NO: 314221 - DNA, 755 bp, Homo sapiens
  misc_feature: GZ8MTXP01ETTE6.3.71.G05.1.454.CMB.2.raw
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaagganacagcctnaagaagcttaattangacaagcgtacggtaaccagcaagaacgccgaaggacacggcccctgtactgcactactaagtaacggtaaaaaccgacccggcctacgaacgggtactacccgaaacgaccgtaatccgtaccgtcggtactaccgacgtcctaaacgaaacggtaacacgtacgttacccttacccgttacgaacctacgttaccgaccgggttacggggacctacgggaacggggaccgggtaaagtaaggttacgggacgggtaccgtaaacgggttaacctttaacgttaaaccggttacgggtaaccgggggtaccccggtttaaacccccgggggaaactaaacccggtaagggttaaaccggtaacccgtaaggtttagggttacgggttacggttaccggggacggggtaacggaaacctaacgttaccggacccgttacgcggtacgaccggttccgaacggtccacccggtccccgttccggacttaccgttcccgttcccggttaacccccg

SEQ ID NO: 314222 - DNA, 616 bp, Homo sapiens
  misc_feature: GZ8MTXP01BBODR.3.71.G05.1.454.CMB.2.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (364)..(364): a, c, t, g, unknown or other
  misc_feature (364)..(364): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctanaagaanctattangacaagctaggaccagcaagacgcaggacacggcccctgtactgtcatctaataggaaaaccaccggcctacgaggactcccagaccgtattctccgtacggctaccagcctaacgaacgaaccncacgtccttactcgaaccatccacggtggggactacggagggacggaagacgtggaggtctagtactacgttacgtcgtaacccggtcccgggacagaccgtaggtacggtaacagtttgagtacgttacggtccgggaacgggtaacgggaaccttaggggtaccgttacccgtacccgttaacgaccgccgttaccccgaacgggtcctcccggtaccccccgtggttacccctcgttcccgtccccggg

SEQ ID NO: 314223 - DNA, 646 bp, Homo sapiens
  misc_feature: GZ8MTXP01D4XK2.3.71.G05.1.454.CMB.2.raw
  modified_base (354)..(354): a, c, t, g, unknown or other
  misc_feature (354)..(354): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaaggagacagcctacaagaagcttaattatgacaagctacggtaaccagacaagaacgccaaggacacggcccctgtacttgtcatactaagtaacggtaaaaaccacccggtccctacgacgggactacccgacgaccgntttaccgtccgtcggcctacgacgtcctaaacgaaggaaccacaacgtccctttacctacgacctacgtccacggtcgggctacggaggacggaagacgtaggacgtactaggactaacgttaacgtacgttaaccggtccccgggacgtacgaccgtaaggttaccgtaaagtagttaggtagtagttacgttccggggaggaacgggaccgttaagggtcgacccgtacctacggacgccgacccgaacggtccaacccgtcccctcggctaaccgttccgttaaccccg

SEQ ID NO: 314224 - DNA, 781 bp, Homo sapiens
  misc_feature: GZ8MTXP01AR8QS.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacacgcctacgaagaagtcttaattatagacaaaggcgtacggtaacccaaggacaagaacgccgaaggacgacggcccctagtacttgtctatactaagtaacggtaaaaaccaccggccctacgaacggactacccaacgaccgtattccgtacccgtcggtacctccgacgtcccgtaaacgaaacgggaactaccgtaacgtcctttaccgtacgaccctagtacccgaggtcggggacctacgggacggggtaacggtaaagtacgggtacggaacggtaccgtaacggtaaacctttacggttaaaccgttacccggggttaaaccccggggcccccgggggttaccgaacggtaccggtaaagggttaacggtaaaccgttagtttaagggtacggttaacgtttaacggggttaccggggaacggggtaaaccgggtaacgttaacggggtacccggttacccgttaccggtaacgttccgacccgggacccgtaaccgggtcccgtaaccccggttcccccgtacggttaccctccgttcccgtttaacccccg

SEQ ID NO: 314225 - DNA, 756 bp, Homo sapiens
  misc_feature: GZ8MTXP01BZ8WP.3.71.G05.1.454.CMB.2.raw
  modified_base (241)..(241): a, c, t, g, unknown or other
  misc_feature (241)..(241): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtgccttgggacagacagtcaggatcacatcgaccaaggacgacagcctacaagaagtctattangacaagctaggaccagacaagaacgaccgaaggacgacggtcccctgtacttgtactactactaacgtaaacggtaaaaaacccgacccggtaccctacgaacggacctacccgaacgtaccgtatttccgtcccgtcggtacctacccgacgtacctaaacgaaacggaaccaccgtaacgtccctttacccgttacgacctacgtcccgtacggtggggacctacgggagggaaccggtaaagtacggtaggaacggtcgttaacggtaactttaacgttaccgtaaccggttaaccccggggtccccggggtaacctacggtaaccgtaaaggttaccggtaacttaggtttaggtacgtaagttacggttaccggggacgggtaaaccggggtaacgttacggggttaccgttaacccggttaccgtaaccggttccggaacccggacccgtaaccgggtcccgttccccgggacccccgtcggttaccctcccgtttcccggttcccccg

SEQ ID NO: 314226 - DNA, 744 bp, Homo sapiens
  misc_feature: GZ8MTXP01EGPMF.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttctctgagctgactcaggaccctgctgtgtctgtggccttgggacagacagtcaggatcacatcgaccaaaggacgacacgcctacgaagtaagtcttaattagtgacaagtcgtacggtaaccaggaccaaggaacgaccgaaggaccacggtcccctagttacttgtactatactaagtaacgtaaaaaacgacccggcctacgaaggtacctaccgagacctattctacctcggctacgagtctaaccgaaaggaaccacgtaactcccgtttacctacgaaccctacgtaccgtacggtcggggtacctacggaacggggaccggtaaagagtacggtagggtacgtacggtaaccgttaaacgtttaaccgttacggttaaaccccggggttccccggggaaccgtaaacggtaccgtaaggttaaccgttaaacgttaggtttaacggtacgttaaaggttacggtttaccgggggaccgggtaaacgggtaacgttaaccggggtacgttaccccggttaccgtaaccggttaccgaccggacccgtaacggccgtcccgtccccgtaccggttcctaaccgttccgttccccg

SEQ ID NO: 314227 - DNA, 778 bp, Homo sapiens
  misc_feature: GZ8MTXP01BS56T.3.71.G05.1.454.CMB.2.raw
  modified_base (461)..(461): a, c, t, g, unknown or other
  misc_feature (461)..(461): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttaattttaaaggtgtccggtgtgaagtgcaacgtggtggagtcgtgggggagcttggtacagcctggcaggtccctgagtactcctctgtcgcagtcctctggattcacctttgattgtatttatcgacccattcgacctacggttcggggtccccggacaaacggtccgttaccccggaaggggggaaccggggtcccgttagggggtacggtttcgggggttccttacggtaaggggtttaaccgtttaacggtttaggggaaagttagtaggtaaaactttaaaaccgngttaccgggtacttaaacggttcggtacccgggtaacttcggtagggttacgggtaaacggggcccggtaacttaccggaaccctaattaccccgtaccgtaacgaaccgggaaaccaaacccgggaacccaaacggttaaaccccgtccccttaggtttaactaccgtacgaacctaaagtacgaaacgtagtcgtagacgtaccgtggaacgtaaccgacggtacctttagtaactttacgttaggttaacggttaaacggtaaccggggtaaaattggtacgttacggttacgttttaaggttaactttaaccg

SEQ ID NO: 314228 - DNA, 685 bp, Homo sapiens
  misc_feature: GZ8MTXP01EQWME.3.71.G05.1.454.CMB.2.raw
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
  modified_base (403)..(403): a, c, t, g, unknown or other
  misc_feature (403)..(403): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttccttttggcttattttaaaaggtgtccggtgtgaagtgcaacgtggtggagtcgtgggggagtcttggtacagcctggcaggtccctgagactctctgtgcagcctntggtattcactttgatgtattancgccatcgccgtacgtcgggtccgacaacgccgtaccggaagggggacgggtccgtagggaggttcgggtctacgtaaggttacttacggttaggaataggtagtaaataacngttcgggtatagtcggacgtactcgtaggtacgacgggtccgtattccacctattcctaccgaagacgaacaaccgaccaaagtaccctccgtagtactactagaactaaactagtaacacggttcgaacggtaacgtacccgtaggaacgggtaacccgttaccgggttacccttttaggtaaacgtttaaccggttagggttaaacggttaaaaccggggtaacccgggtaaaattcgttaacggttaacgtttagtttttaacgttaacgttttaaccg

SEQ ID NO: 314229 - DNA, 564 bp, Homo sapiens
  misc_feature: GZ8MTXP01BK1DP.3.71.G05.1.454.CMB.2.raw
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (336)..(336): a, c, t, g, unknown or other
  misc_feature (336)..(336): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctnagaanctatangcaagctgacancagancagacacggcccctgtactgtcatactaagtaacggtaaaaaccaccggtccctacgaaggacctacccgagaccgtattccnccgtcggctccgagcctaacaacggaacacacgtccttcctacgaccatcacgtgggactcgagggtacgaagtacgtgacgtcagacttagtacgtacgtaaccgggtcccggacagactagtacggtactagtagtagtatacggtcggagggaacgacgaggtcgaccgtcgtacgttcgacgttaccgaaggcctccgtcccctggttacctcgttccgtcccg

SEQ ID NO: 314230 - DNA, 797 bp, Homo sapiens
  misc_feature: GZ8MTXP01CN7KU.3.71.G05.1.454.CMB.2.raw
  modified_base (221)..(221): a, c, t, g, unknown or other
  misc_feature (221)..(221): n is a, c, g, or t
  modified_base (380)..(380): a, c, t, g, unknown or other
  misc_feature (380)..(380): n is a, c, g, or t
tcagagacgcactccacgaccggtgctcgattttagtgtcgtcgcaagagagagggggcagaagcagagttctggggtgtctccaccatggcctggacccctctctggctcactctcctcactctttgcataggttctgtggttttcttctgagctgactcaggaccctgctgtgtctggtgccttgggacagacagtcaggatcacatcgaccaaagggngacagcctagaagaagcttaattagcgacgaagtcgtacgtaccagcaagaacgccgaaggaccgccggtccccttagttaccttgtactaactacgtaaagtaaaccggtaaaaccaccccggtcctaacggaacggaccttacccgaagaaccgttnttcctaccgtcggtactaccgagaccctaaacgaacggaacaccgtacgtccctttaccgtacgaacctacgtaccgtacgggttacggggaccttacgggaacgggtaacggtaaacgtaacggtcgggtaaccggtacggttacgtaaaccgtttaaacgtttacgtaaacccgggttaaccccggttacccggggacgtttaacgggacgttaaacggggttaacgtaaaccgttacggtttaggtacgtaaccggtttaggttccgggggaacggtaacggggtaaaccttacgggttacccggttacccgttaccggttaacgcccggttaacggttaccccgggtaacgggtccccttaacccggggttcccccgttcggttaacccttcccgttcccgtttaacccccgg

SEQ ID NO: 314231 - DNA, 697 bp, Homo sapiens
  misc_feature: GZ8MTXP01COQNH.3.71.G05.1.454.CMB.2.raw
  modified_base (246)..(246): a, c, t, g, unknown or other
  misc_feature (246)..(246): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggttttcttctgagctgactcaggaccctgctgtgtctgtggccttgggacagacagtcaggatcacatgaccaaaggagacagccctacgaagaagtctaattaangacaagctaggtaccagacaagaacgccgaaggaccacggcccctgtacttgtcatctaagtaacggtaaaaccacccggccctacgaaggacctcccgaagaccgtattccgtacccgtcggtacctaccgagtccctaaaccgaaacgggaaccaccgtaacggtcctttaccgtacgacctactccgtaacggtcggggtacctacggaagggacggtaaagagttacgggacggtctaaggaacctttaacgttaccgtacggtaaccccggtccgggacaacggacgtaaggttacggtaaacttggttacgtagtaacgttagggttaccggggacggggtaaacggggaaccgttaggggtccgaccccgttaccgtacgttaccgaccggttacccgaagtccccgtccgcccccgttaggaccctccgttcccgtttccccg

SEQ ID NO: 314232 - DNA, 621 bp, Homo sapiens
  misc_feature: GZ8MTXP01A26FH.3.71.G05.1.454.CMB.2.raw
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (361)..(361): a, c, t, g, unknown or other
  misc_feature (361)..(361): n is a, c, g, or t
  modified_base (606)..(606): a, c, t, g, unknown or other
  misc_feature (606)..(606): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttctctgagctgactcaggaccctgctgtgtctggtggccttgggacagacagtcaggatcacatcgaccaagganacagcctanaagaagcttattangacaagctaggtaccagcaagaacgccgaaggacacggtccctgtacttgcctatctaataagaaaaccaccggcctgaggactccagaccgattctacgcgctcagctaacgaagaacncacgtctacctgaccatccacggtcggacctacggaggtacgaaagtatcggaacggtcttaggaaccttaagttaccgtaccggttaaacccggtccccgggacgaacacgtaacggtacggtaaattgttaggtagtaacgttacggtacgggacgggggaaacgtaaccgttaagggttcccgaaccgtttaccgacgttccgaccggaccgtaacggtcctcccggccccctggttacccnccgttcgtaaccccg

SEQ ID NO: 314233 - DNA, 702 bp, Homo sapiens
  misc_feature: GZ8MTXP01C5FST.3.71.G05.1.454.CMB.2.raw
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggnacngcctnagantatngcagctgacagcagagcagacncgcccctgtactgacatactaagtaacggtaaaaccaccggtaccctacgacgggtaacctcccgaacgtaccgtatttccgtaccgtcggtccttaccgacgccctaaaccgaaacggaaccacgtacgtaccctttccctacgacctagttccgacggtggggcctacggacgggacggaaagtacgttggacggtcgtacgaaacttaagttaaccgtaccggttaacccggggtccccgggacgtaacggtacgtaaacggttacggtaaaccgttgtttacggtaggtaacgtttaacgggttcgggacggggtaaacgggtaaccgttaagggtcccggttaacccgttacccgtaacggttaccgaacccgacccggtaaacgggtcccgttccccgggtcccccgttacggttcctaacccggtttcccgtttcccccgg

SEQ ID NO: 314234 - DNA, 604 bp, Homo sapiens
  misc_feature: GZ8MTXP01DW0AD.3.71.G05.1.454.CMB.2.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaaggagacagcctanaagaagctattangacaagctggtaccagcagaagccaggacaggcccctgtactgcatctaataacggtaaaaaccaccggccctacgaacgggactcccgaagaccgattcctccgtggactccgaagcctaacaaggaaaccacacgtccctttacctagaaccctatccaacgtggggctacggaggcgaaagactggaacggctagaacttaattacgtacggttaaacccgcccggggacaagcgaaagtcggtaaactagttgtagattacgtcgggacggtaagggaaccaaagggtcgaaccgtccgtaacgttcgacgaccccgaaggccctcgacccccgtggttcctaaccgttcgttccccgg

SEQ ID NO: 314235 - DNA, 774 bp, Homo sapiens
  misc_feature: GZ8MTXP01B781S.3.71.G05.1.454.CMB.2.raw
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttccttttggcttaattttaaaggtgtccggtgtgaagtgcaatggtggagtcgtgggggagtcttggacagcctggcaggtccctgacgactctcctgtgcagcctctggacttctacctttgattgtattatcgccctagtcgctacgtcgggggtcccgacaacgccgtacccggaagggggtaacggggtcctaggggacggttcgggggtccttaccggtaagggtttaacgttttacggttagggtaaacttaagggtacgtaagttaaaccgaagttccgggtacttaggtcgggtacgggtaacctttcggttagggtacgggaaacgggggtccctaactttacccgaacccgtacttacccgtacccgaaaggtaaaccgaacccaaaccggaccccgtaaaacggtaaccccttcccggttaagttactacgtacgaaactaaacgtacgaacctacgtaccgtacggaacgaacccgttaggaaccgggacccgttaccgggttacctttaggttaacgtttaccggttagggttaacggttaaaaccgggttcccgggggtaaaattgttacgggttaacgtttaaggtttttaaccgg

SEQ ID NO: 314236 - DNA, 660 bp, Homo sapiens
  misc_feature: GZ8MTXP01A2R34.3.71.G05.1.454.CMB.2.raw
  modified_base (237)..(237): a, c, t, g, unknown or other
  misc_feature (237)..(237): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcagaagctattangcaagctgtaccagcagaagccaggacacggcccctgtacttgtcatctaataacggtaaaaaccaacccggccctacgaacgggactacccgaagaccgtattccgtacctcggctacccgagcctaacaacggaacacacgtccttacctacgaaccagtccaacgtggggtcctacggaacgggacggaaaggtacgtacgggaacgggtctacggtacctttaagttaaccgttacggttaaacccgggtccccggggacctaagaccggtaagttacgggtaaactagtttaccggtagtaagttacggttcggggacggggaaacggtaccgaagggtcgacccggtaccgtacggttaccgccgaccccgaaggcccgtaaccgcccccgtcggttcctaaccgttccgtccccgg

SEQ ID NO: 314237 - DNA, 660 bp, Homo sapiens
  misc_feature: GZ8MTXP01CTN9C.3.71.G05.1.454.CMB.2.raw
  modified_base (227)..(227): a, c, t, g, unknown or other
  misc_feature (227)..(227): n is a, c, g, or t
  modified_base (649)..(649): a, c, t, g, unknown or other
  misc_feature (649)..(649): n is a, c, g, or t
tcagagacgcactccacgaccggtgctcgatttagtgtcgtcgcaagagagagggggcagaagcagagttctggtgtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctanaagaagctaattatgcaagctggtaccagcagaagccaaggacacggcccctgtactgtcatctaagtacggtaaaaaccaccggccctacgacgggactcccgagaccgtattccctcgtcggcctccacgcctacgaacggaaaccacgacgtccttacctacgaccactccgtacgtcggggcctacggaagggtacggaaagtagtacggacgggtactaggtaaccttaagttacccgtacggggttaaccccggtccccggggtacaacggtaccgtaaggtacggttaacttaggtttgtaggtaacgttcggttacggggaacgggaacgggaaccggtaagggttccgtaacccggtccgttaacgttccgaccggcccgaacggtcccgtcccgtaccccgttcggttcccnccgtttccccg

SEQ ID NO: 314238 - DNA, 649 bp, Homo sapiens
  misc_feature: GZ8MTXP01CEGJ0.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaaagggacgacagcctacgaagaagcttaattatgacaagctaggtaccagacaagaacgccgaggacacggcccctagtacttgctatactaagtaacggtaaaaaccaccggacctacgaacggactacccgaagaccgtattcctacctcggctcctagcctaaacgaacggaaccacacgtccttacctacgaccaatcacggttggggacctagacgggacgaagagtgggaacgtcgtacgtaacttagttaccgtaccgtaaccggtccccggggactagtaccgtaaggtacggtaatagtttagagtaagttcggtaccgggacggggtaacggaaccgttagggtcgttacccggtccgtacggttaccgcgacccgaacggtcccgtcccggcccccgtaggttccctaaccgttcccgttccccg

SEQ ID NO: 314239 - DNA, 752 bp, Homo sapiens
  misc_feature: GZ8MTXP01DQ3F3.3.71.G05.1.454.CMB.2.raw
  modified_base (246)..(246): a, c, t, g, unknown or other
  misc_feature (246)..(246): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcaacatgaccaaaggacacagccctacaagaagtcttaattangacaagctaggtaaccagcaagaacgccgaaggacacggccccctgtactgtactatactaagtaacggtaaaaaccaccggtaccctacgaacgggactacccgacgtaccgtattcgtcctcggcctaccacgtcctaacaacggtaaccactaacgtccttaccctacgacctacgtaccgtaaccgtggggaccttacggaacggggaccgggtaaaagtaacgtagggtaacgggtaccgtacggtaaacctttaaacgttaaccgttaccgggttaaaccccggggttaccccccggggaccgtaaacggtacccgtaaaggttaacgggttaaacctagttttacggtacgtaaggtttacggttaccggggacggggtaaacggtaaccggttaaacggggtcgttaaaccccggtaccgtaacggttaccgacggttaccccgaacgggtccctccggtacccccgtcgggttacctaaccgttccgtttaaccccg

SEQ ID NO: 314240 - DNA, 731 bp, Homo sapiens
  misc_feature: GZ8MTXP01ARD7C.3.71.G05.1.454.CMB.2.raw
  modified_base (274)..(274): a, c, t, g, unknown or other
  misc_feature (274)..(274): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttccttttggctattttaaaggtgtccggtgtgaagtgcaactggtggagtcgtgggggaggcttggtacagccgtggcaggtccctgagactctcctgtgcagcctctggnttcaccttgatgatatgccatgcacgtcgggtccggacaacgctaccgagggaacgggccgtgggacgtggggtctccgaggtttattacgttagggaattaaggtaggtaactaaacgaacggtcggttacccttaagttcggaccgggtaacccgttcttacggggttagggaaaccgggggtcccgggtaaacgtttacccgaacccgtaccgttaccttaccccgaaacggtaaccgaaaccccgaaacccggtaaccccgaaaacggggaaacccctttacccccttaacggttaacgttacccgtagttaaaccgaaaattacgaaacgtacgttaccgtacgaacgtaacccggtaggaacgggaccacggggtcccttagttacgtttacgttgtaaggtaacggtaaccggggtaaataggttcgtaaccggttaagtttttaaccgg

SEQ ID NO: 314241 - DNA, 977 bp, Homo sapiens
  misc_feature: GZ8MTXP01ENX5J.3.71.G05.1.454.CMB.2.raw
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggctattttaaaaggtgtccggtgtgaagtgcaactggtggagtcgtgggggagcttggtacagcctggcaggtccctgagactctcctgtcgcagcctctggtacttcacctttgatgaattatcgccctatcgctacggtcgggtacccggacaacggtccgtaccggaagggggaaccggggtcccgttagggggacggttcgggggtacctacggtaaggtttaacctttaacggttagggtaaaacgttaggtagtaaaaaacgttaaacgtaacggtttccgggtaacgttaaacgtcggggtacccggggttaaacttccgggtttagggttaacgggggaaaaccgggggtccccggtttaacgtttaccccgtaaaccccgttaactttacccccgtaacccggtaaacgggaaaccccgggtaaaacccctaaaaccccggggaaacccccttaaaaaccgggttaaaacccccccgtttcccccgtttaacggggttttaaacctttaccccgtttaaaccgggaaaaccttaaaaacgggttacggtaaaaccccgtaaaggttttcccgtaacggggtaaacccggtaaaccccgggttacgggaaaccggggtaaaccccgttaacccggggtttacccgtttttaaagggttaaaccgttttaacgggttaacggggtttaaacgggttaaaaaccccggggggtttaacccccgggggtaaaattttaaccgggtttaacgggtttaacccggttttaaggttttttaaccgggtttaaaccctttttaaacccgg

SEQ ID NO: 314242 - DNA, 725 bp, Homo sapiens
  misc_feature: GZ8MTXP01C42VE.3.71.G05.1.454.CMB.2.raw
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggctattttaaaaggtgtccggtgtgaagtgcaacgtggtggagtcgtgggggagtcttggtacagcctggcaggtccctgacgactctcctgtgcagcctcgtgattcacctttgattgaattatcgccagtcgcctacggtacgggtcccgacaaacggtcctaccggaagggggtaacgggtcccgtagggggtacggttggggtcctacggtaaggtttaacctttaccggttaagggtaacgttaaggtacgtaaaacttaaacgtcgttaccgggtaccttaagtcggccgggtaacttcggtaggtacgggtaacgggtaccgtaattaccacctacgtacctaccgaagaacgaaccaaccgaaccaaacgtaaccctccgttacgtacttacacgaaacaaagtacgaacgtaacgtctaggtacgtacccgtaaggaaccggtaacgaccgggttacccttaggttaacgttacgttagggttacgttaaaacgggtaacccgggtaaattaacgttacgtacgtttagttttaacggaacttttaaccg

SEQ ID NO: 314243 - DNA, 656 bp, Homo sapiens
  misc_feature: GZ8MTXP01DG8FE.3.71.G05.1.454.CMB.2.raw
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcaacatcgaccaaagganacagccctanaaggaagtcttaatttagacgacaaggtcgtaggtaacccagcaagaacgccgaaggacacggcccctagtacttgtacatactaagtaacgtaaaaacacccggacctacgaggactcccgaagtaccgtattcgtcctcggtctaccgacgctaacgaaacggaaccacgaacgtaccttcctacgacctactaccgacgttgggctacggaggacggtaagagtgagtccgtagtactataacgtacgtaccggtcccggacacgacgaagtacgtaactagttagtagtaagtacggttccgggaagggaacgggtaaccgttaacgggtccgttaacccgtaccgtaacgttaccgacgacccgaacggtaccctcccggtaccccgtacggttaccctaaccgttcccgtttaaccccg

SEQ ID NO: 314244 - DNA, 722 bp, Homo sapiens
  misc_feature: GZ8MTXP01D7FQ6.3.71.G05.1.454.CMB.2.raw
  modified_base (78)..(78): a, c, t, g, unknown or other
  misc_feature (78)..(78): n is a, c, g, or t
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
tcagagacgcactccacgaccggtgctcgatttagtgtcgtcgcaagagagagggggcagaagcagagttctggggtntctccaccatggcctggacccctctctggctcactctcctcactctttgcataggttctgtggttttcttctgagctgactcaggaccctgctgtgtctggtgccttgggacagacagtcaggatcaacatgaccaaagganacagcctanaagaacgtcttaattancgacaagcgtacggaaccagacaagaacgcgaaaggaccaccggtccccgttagttacttcgtactacttacgttaaacgtaaaaccggtaaaaaaccaccccgggtacctacggaacgggtacctaccccgaaagtaccgtacttcctccgtccggtacctaccgagtcccgtaaaacgaaaaccggtaaccacgtaaccgttcccctttaccgtacgaaccctagtacccgtacggtcggggtacctacgaacgggacggaaagacgttacgaggtaccgttaagtaacttaacgttaccgtaaccgtacccggggtaccccggagaacggtacgtaacggtaagtaacgtagttaggtcgtaagtacggtacgggagggaacggtaccggttaggtaccgaccgtctacggttacgccgaccgaacggtcccgtcccgtccccgtacgttccctaaccgttcccgttccccgg

SEQ ID NO: 314245 - DNA, 666 bp, Homo sapiens
  misc_feature: GZ8MTXP01BG4FN.3.71.G05.1.454.CMB.2.raw
tcagagacgcactccacgaccggtgctcgatttagtgtcgtcgcaagagagaggggggctgggagaggagccccagccctgagattcccaggtgtttccattcagtgatcagcactgaacacagagactcaccatggagttgggactgagctggtattttcctttggcttattttaaaaggtgtccggtgtgaagtgcaactggtggagtcgtgggggagtcttggtacagcctggcaggtccctgagactctcctgtcgcagcctctggtacttcactttgattgtattatcgcctagtgccgtacgtcggggtccggacaaggccgtaccggagggggtaacgggtccggtgggacggttgggtactacggtaaggttactttacgttaggtaactagtagaaaactaacaagtcggtactagtcggacgtactacgtggtagtacgggccgtacgttaccacctactcctaccgaacgacgaaccgaaccgaccaacgtaacccttccggtacgttactacctacgaactaaacgtacgtaaacacgtctacggtaacgtaccgtgaacggacgttaccggtcttagttacttacgttaggttacggttaacggtaaccggggtaaattaagtacgtacgttatttaacggttaactttaacg

SEQ ID NO: 314246 - DNA, 613 bp, Homo sapiens
  misc_feature: GZ8MTXP01A0SHQ.3.71.G05.1.454.CMB.2.raw
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttccttttggcttaattttaaaaggtgtccggtgtgaagtgcaactggtggagtcgtgggggagtcttggtacagcctgggcaggtccctgagctctcctgcgcagcctctggattcactttgatgattatgccatcgctacgtcgggtccgactaacgccgtaccgagggggacgggcctgggaggtcgggtctaccgagggttattacgtggaataagtagaattaacagtcgggactagtcggacggtacctgtgtagggaacgggccgtattccaaccacgtaccaccgaagacgaaccaaaccgtacccaaagggtaccctcccgtatacgtaccgtgaaccaagtacgaacaggtcctacggacaaccgtagacggccaggtcccttagacttacgttgtaaggtaacggtaaccgggtaatacgttataacggttctttaacgg

SEQ ID NO: 314247 - DNA, 631 bp, Homo sapiens
  misc_feature: GZ8MTXP01DH4OB.3.71.G05.1.454.CMB.2.raw
  modified_base (216)..(216): a, c, t, g, unknown or other
  misc_feature (216)..(216): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagcctacaagaagcttaattatgacaagctggtaccagcagaacgccgaaggacacggcccctgtacttgtcatctaagtaacggtaaaaaccacccggcctacgaggactctacacgaccgtactttccctccgtggcctccgagaccctacgaacggaaaaccacgacgtccttacccgttagacctatccacggtcgggctacgagggacggaaagagtggacggctacgaacttaagttaccgttacgggtaacccgtcccggggaccacggacgtaaggtacggtaactagttgtagtagtacggttcggggaacgggtacgggaaccgtaaacgggttcgtaacccgtaccgttacgttcaccgaacccgaacgtcctacccgccccgttcgtccgaaccgttcccg

SEQ ID NO: 314248 - DNA, 619 bp, Homo sapiens
  misc_feature: GZ8MTXP01BZGOI.3.71.G05.1.454.CMB.2.raw
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
  modified_base (303)..(303): a, c, t, g, unknown or other
  misc_feature (303)..(303): n is a, c, g, or t
  modified_base (339)..(339): a, c, t, g, unknown or other
  misc_feature (339)..(339): n is a, c, g, or t
  modified_base (379)..(379): a, c, t, g, unknown or other
  misc_feature (379)..(379): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttatttaaaaggtgtccggtgtgaagtgcaactggtggagtcgtgggggagcttggtacagcctggccaggtcccngagctctcgtgtgcagcctntggatcactttgatgattatcgcatgcgcgtgggtccgnaagccgtacgagggggaacggctggacggtggtacncgtaaggttacttacggttaggaatagtgaaacttaacgngtacgctatcggacggtactgtggtaggaacgggtccgtattaccgaacctattcccacgaacgacaaccgaacgaccaaacgtaccttccgtagtactctacgactaaagtcgaaactggttacacggtacgaccgtcggaacggtacccgacgttccgttaagttacttacgttaggttacgggttaaacgtaacccggggtaaatgttacgtagtttcttttaacggaactttaacg

SEQ ID NO: 314249 - DNA, 685 bp, Homo sapiens
  misc_feature: GZ8MTXP01EOJ9L.3.71.G05.1.454.CMB.2.raw
  modified_base (78)..(78): a, c, t, g, unknown or other
  misc_feature (78)..(78): n is a, c, g, or t
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
tcagagacgcactccacgaccggtgctcgatttagtgtcgtcgcaagagagagggggcagaagcagagttctggggtntctccaccatggcctggacccctctctggctcactctcctcactctttgcataggttctgtggtttcttctgagctaactcaggaccctgctgtgtctgtggccttgggacagacagtcaggatcacatgccaaggagacagcctnagaagtctattancgacaagctggtaccagacgagaacgccaggaacacggcccctagtacttgtcatctaagtacgtaaaaaccgaccggacctacgacgggactaccgagaccaatcctacgtcggcctaccgagacctacgaaaacggaaactcgtacgtcccttaccgttcgaacctactacgtaacgtcggggtcctacggacgggacggtaaagcgtacgggacggtactacggtaacttaacgttaaccgttagggtaccgtacccggggtaacccgggaacgtaaccgtacgggttaacgggtaaacctggttgggttaacgttacgggtaccggggagggtaaccggtaaaccctaacggtacggttaccggtaccgttacggtaccgacccgacccggttaggttcccgtcccgccccgttcgccctcttccgtcccgttcccctaacccg

SEQ ID NO: 314250 - DNA, 729 bp, Homo sapiens
  misc_feature: GZ8MTXP01ALOAK.3.71.G05.1.454.CMB.2.raw
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttccttttggcttaattttaaaaggtgtccggtgtgaagtgcaactggtggagtcgtgggggagtcgttggtacagcctggcaggtccctgagtactctcctgtcgcagcctctggacttctacctttgatgtattatcgcctatcgctacggtcggggtcccgacaacgtccgtacccgaagggggaacgggtcccgttaggggaggttcggggtaccttccggtaaggtttagtttacgtttaggggaattaaagggtagaacttaaacgagttacccggagttaacgtcggtacggtactcggttaggtacgggaaacgggtcccggtaacttaccgaaaccctacgtttacccgaccgaacggaaccgtaaaccgaaaccggaccctaaacggggtaaacccttccccgtaagtacttccgagaacaaagttacggaaacctagtacctagaacgtaacccgtggaacgggtaccttacgggtaccttggttaactttaccgagggtaaccgtaaacgggtaacccgggtaaattcgttacgttaacgtttaagttttaacgg

SEQ ID NO: 314251 - DNA, 776 bp, Homo sapiens
  misc_feature: GZ8MTXP01CLSX5.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcaacatgaccgaaagggagaccagcctacaagaagtcttaattatcgacaagctagggtaacccagacaaggaacgccgaaggacgacggccccctgtacttgtacatctaagtaacggtaaaaccaccggcctacgaagggactacccagaccgtacttctacctcggactccgacgtcctaacgaaaggaaccacgtacgtaccctttacctacgaccctacgtaccgtacggtcggggtacctacggaacggggaaccgggaaaggtacgtacgggaacggtactacggtaaaccttaaacgtttacccgttaacgggttaaccccggggtacccccggggtaccgtaaaccggtaccgtaaacgggttaacggttaaaccgtagtttaacggggtagttaaacggttacggtttaccgggggaaccggggtaaaccgggggtaaaccgttaaacgggggttacccgaacccggttaccccgtaacggttaccgaaccgggaccccggtaaacgggtcccgttaacccgtcccccggtacggttccctaacccgttccgtttaacccccg

SEQ ID NO: 314252 - DNA, 536 bp, Homo sapiens
  misc_feature: GZ8MTXP01BJD7V.3.71.G05.1.454.CMB.2.raw
  modified_base (344)..(344): a, c, t, g, unknown or other
  misc_feature (344)..(344): n is a, c, g, or t
  modified_base (433)..(433): a, c, t, g, unknown or other
  misc_feature (433)..(433): n is a, c, g, or t
tcagagacgcactccacgaccggtgctcgatttagtgtcgtcgcaagagagaggggcagaagcagagttctgggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtactgcatctataggtaaaaacaccggccctcgaggactcccagaccgattctcctggctcagctacagaacncagcttctgaccatcactggggctacgaggacggaagagtggaggtcagactagttactcgtaaacgtcccgggacagcagtggtaacngttcgtgtacgtagttccgggcggtaagggaccttaagggtcgaccgtccgtacgttcgacgccccgaaggccctcggccccctggttccaaccttcgtcccg

SEQ ID NO: 314253 - DNA, 793 bp, Homo sapiens
  misc_feature: GZ8MTXP01D21PE.3.71.G05.1.454.CMB.2.raw
  modified_base (523)..(523): a, c, t, g, unknown or other
  misc_feature (523)..(523): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttccttttggtctattttaaaaggtgtccggtgtgaagtgcaactggtggagtcgtgggggaggcttggtacagccgtggcaggtcctgagtactctcctgtgcacgcctctggtacttctaccttgatgtaattagtcgcatcgcacggtcgggtccgacaagcgtaccggaagggggtaacgggccgtgggaggttcgggtcgtacgtaaggtttacttacgttaggtaaagttagtaggtaaaaaacgttaaacctaagttccgggtaccttaggtacggtaccgggtaccttacgggtggttaaccggggaaacgggtacccggttaattacccgaaccgtacttaacccgcccggaaaanaacccgggtaaaccaaaaaccccgggcctaaaaaaccgggtaaccccttttacccccggtaagggtttaaacccttaccgggtaaacgtaaacctaaaacggttacgaaaccgttaacgtaccgtacggtaaaccgtacccggtaagggtaaacccggtaccggttaccggtttaaccgtttagtaaacgtttaacgttagggttaaacggttaaaccggtaacggtaaattgtacggttacgtttagttttaacgttaaccgtttaacg

SEQ ID NO: 314254 - DNA, 772 bp, Homo sapiens
  misc_feature: GZ8MTXP01DW89C.3.71.G05.1.454.CMB.2.raw
tcagagacgcactccacgaccggtgctcgatttagtgtcgtcgcaagagagaggggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaagaagcttattatgcaagctaggtaccagcagaagccaaggacaggcccctgtactgtacatctatacggtaaaaaaccaccggaccctacgaaggactacccgacgacgacttctaccgtcggactccacgctaacgaacgtaacactaagtcctttaccctacgaccctactccgaacgttacgggggctacggaacgggcgggaaacggtagtacggtaacgggtcgtacgtaaccgttaacgttaaaccgttaaccggttaaaccccgggttcccccggggactaaaccggtaccggtaaaggttacgggtaaaccgttacgtttaacgttaggtaaacgtttacggtttacccgggggtacgggggaaaaccgggggttaccgaaaccggggttaccggttaaacccgggttacccggttaaccgggttaacccgacccgggttaaccccccgtaaacgggggtaacccctttcccgggtaccccccccccggttcggggttaaccccttaaccccggtttcccggttttaacccccccgg

SEQ ID NO: 314255 - DNA, 730 bp, Homo sapiens
  misc_feature: GZ8MTXP01AGQP7.3.71.G05.1.454.CMB.2.raw
  modified_base (452)..(452): a, c, t, g, unknown or other
  misc_feature (452)..(452): n is a, c, g, or t
  modified_base (715)..(715): a, c, t, g, unknown or other
  misc_feature (715)..(715): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgttggtttcttctgagctgactcgacgggccctgctgtgtcgtggtggccttgggacagacagtcaggatcacagtcgaccaaaggacgaccacgcctagaaggtaactacttaattagtgacgaagtcgtacggtaccaagacgaaggaacgcgaacggtaccgaccggtccccgtagtttaccgttgtactacttacgtaaacgttaaacgggaaaaaaccgaccccggtacctacggaaccggggtaacctacccgaacggtaaccgtacttccgtccgtacggccgtacacgtctaaacgaacggtaaccnctacggtccctttaccttacggaactacgtacgtaccggtcgggtacctacggacgggaccgggaagtacggtagacggtacgtacgtaaccgttacgttacgtacgtaccggggtccgacgtacgacgtagtaacgtacgtagttaggtacgtgttacgtacggggcgggtaaacgggaacgttagggtacccgacgtaccgttacgacggttacccgttaccgaacggtcccgttaacccgccgtacgttaccggttaacncccgtttaaccccgg

SEQ ID NO: 314256 - DNA, 611 bp, Homo sapiens
  misc_feature: GZ8MTXP01DQ6BV.3.71.G05.1.454.CMB.2.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (498)..(498): a, c, t, g, unknown or other
  misc_feature (498)..(498): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcattaggttctgtggtttcttctgagctgactcaggaccctgctgtgtctggtggccttgggacagacagtcaggatcacatcgccaaggnacagcctcagaagctaatngcagctgtacagcagaagcagacagcccctgtactgcatctaactaaggaaaaccaccggtcctagaaggtacctaccgacgaaccatcgtcccgtacggctccgagtcctaacgaacggaacctagaccgttcctttaccgtacgaacctacgtccgtacggtcggggaacctacgaaggggccgaaagactagggacgtctagaacgtaatttagacggtacgggtacccgtccgggaaataccgaggtaccgtaaacnggtacgtgtacgtcgggtacgaacggtaacaaaccgttgaaaccccgttgtacacgttacgaaccgttacgtccgtacgtccccgtcggacttcctccgttaacctaaccccg

SEQ ID NO: 314257 - DNA, 507 bp, Homo sapiens
  misc_feature: GZ8MTXP02JT6KA.3.71.G05.1.454.CMB.2.raw
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtactgcatctaataggtaaaaacaccggccctacagggactcccagaccgattcncctggctccagctacagacncagcttcctgaccatcactggggctcgaggcgaagatgaggctgactattactgtaactcccgggcagcgagtgtaacagttgtgatagtcgggcggagggaccaaggtcgaccgtcctacgtcacgcccgaaggcctcgaccccctggtccactctccg

SEQ ID NO: 314258 - DNA, 628 bp, Homo sapiens
  misc_feature: GZ8MTXP02FVX3I.3.71.G05.1.454.CMB.2.raw
  modified_base (336)..(336): a, c, t, g, unknown or other
  misc_feature (336)..(336): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagccctacaagaagctattatgacaagctggaccagcagaagccaggacacggcccctgtacttgcatctaataggtaaaaaccaccggccctacgaggactcccagaccgattcnccgtgcctcagctacaaggaacacagtccttacctgaaccatccacgtggggcctacgaggacgaaagatggaaggctagaacttattacgtacgtaaaccgtccccgggacagaccgtaaggtacggtaaactagtttaggtagtaacgttaggttaccgggacggggtaaacggggaccgtaaagggtccggtaacccggttacccgtaaccggtaccgaaccggacccccgaaaggggcccttacccggaccccccggttcggtaccctaacccgttcctttacccccg

SEQ ID NO: 314259 - DNA, 548 bp, Homo sapiens
  misc_feature: GZ8MTXP02GYCD6.3.71.G05.1.454.CMB.2.raw
  modified_base (366)..(366): a, c, t, g, unknown or other
  misc_feature (366)..(366): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttcctttggctattttaaaaggtgtccggtgtgaagtgcaactggtggagtctgggggaggcttgggtacagcctggcaggtccctgagactctcctgtgcagcctctggattcacctttgatgattatgccatgcacgtgggtccggcaagctccgaggggacgggcctggagtgggtctcgaggtattacgtggaatagtgataacngtcggctagtgcggtactctgtgaaggccgagttcaccatctccagagacaacgaccaaagacctccctgtactctgacaaatgaacagtctagacgacctgaacggacacggtccttagtactacgtgtagtaaacggtcccgggaaaatacgtacgtacgtagttttacggaactttacg

SEQ ID NO: 314260 - DNA, 498 bp, Homo sapiens
  misc_feature: GZ8MTXP02GARB7.3.71.G05.1.454.CMB.2.raw
  modified_base (236)..(236): a, c, t, g, unknown or other
  misc_feature (236)..(236): n is a, c, g, or t
  modified_base (431)..(431): a, c, t, g, unknown or other
  misc_feature (431)..(431): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattangcaagctggtaccagcagaagccaggacaggcccctgtacttgcatctaataggtaaaaaccaccggccctgagggactcccagaccgattctcctggctcagctcaggacacagcttcctgaccatcacgtggggctcgaggcgaagatgagctgactatactgtaactcccgggacagcagtgtaacattganatagtcggacggaggaccaaggtcgaccgtctacgcacgcccaaggctcgcccctggtcactctccg

SEQ ID NO: 314261 - DNA, 512 bp, Homo sapiens
  misc_feature: GZ8MTXP02GIOKI.3.71.G05.1.454.CMB.2.raw
  modified_base (236)..(236): a, c, t, g, unknown or other
  misc_feature (236)..(236): n is a, c, g, or t
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
  modified_base (386)..(386): a, c, t, g, unknown or other
  misc_feature (386)..(386): n is a, c, g, or t
  modified_base (402)..(402): a, c, t, g, unknown or other
  misc_feature (402)..(402): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgccaaggagacagcctcagaagctattangcaagctggaccagcagaagccaggacaggcccctgtactgcatctaataggtaaaaaacaccggccctagaggactcccagaccattcnctgctcagctacaaggaacncagcttcctgaccatcaacgtggggctcgaggcgaaagangagctagactattacngtaaactccgggcagcagtacgtaanattganatagtcggaggacgggacaaaggtcacccgtactacgacacgacccaaaggcctcgccccctggtcacctcgttaccc

SEQ ID NO: 314262 - DNA, 561 bp, Homo sapiens
  misc_feature: GZ8MTXP02HH35U.3.71.G05.1.454.CMB.2.raw
  modified_base (238)..(238): a, c, t, g, unknown or other
  misc_feature (238)..(238): n is a, c, g, or t
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
  modified_base (391)..(391): a, c, t, g, unknown or other
  misc_feature (391)..(391): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctacagaagctattangacaagctggaccagcaagaagccaggacacggcccctgtacttgcatctataaggtaaaaaccaccggccctacgagggactacccagaccgattcncctggctcagctacaagacncagtccttctgacatcacgtgggctcgaggcgaanagtggagctagactattacgagtaaccgtcccgggacagccgtaagtacgtaaactgttagtagattacggtcgggacgggtacggaccgtaaaggttccgaccgttaccgtacgaccgacgaccccgaaggtccctaccgcccccgttaggccctacgttccgttcccg

SEQ ID NO: 314263 - DNA, 578 bp, Homo sapiens
  misc_feature: GZ8MTXP02F2QN0.3.71.G05.1.454.CMB.2.raw
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
tcagagacgcactccacgaccggtgctcgatttagtgtcgtcgcaagagagaggggcagaagcagagttctgggtgtctccaccatggcctggacccctctctggctcactctcctcactctttgcataggttctgtggtttcttctgagctgactcaggaccctgctgtgtctgtggccttgggacagacagtcaggatcacatgccaaggngacagcctnagagctattangacaagctaggtaccagacagaacgccgaggacacggcccctagtacttgcatctagtacgtaaaaaccaccggcctacgagggactacccgagaccgtattctccgtggcctacacgtctacgaaggaaccacacgtcctttcctagaacctactcacgtggggcctacgagggacgaaagagtggaggctagaacttattacgtacgtaaccgtcccgggacagacgtagtacgtaatgttgagattaagtcggacggacggtaaccgtaggtcgtaccgtaccgtacgtacgaccgtaccgaacggtcctaccggcccccttggtaccacctcgttaccccg

SEQ ID NO: 314264 - DNA, 572 bp, Homo sapiens
  misc_feature: GZ8MTXP02G381Y.3.71.G05.1.454.CMB.2.raw
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccgtgctgtgtctgtggccttgggacagacagtcaggatcacatgccaaggagacagcctcagaagctattatgcaagctggtaccagcagaagccagacaggcccctgtactgcatctatacggtaaaaacaccggccctcagggactcccagaccgattcnctggctccagctacaggaacncagccttccttagaccatcacgtggggcctacgaggcggaagatggaggctagactattacgtgtaaacccgtcccgggacaaggctaaggtacgtaaactagtttgtagattaagtcggggacgggtaacgggacccgtaaaggggttccgacccggtaccgttaccggccacggtaccccaaagggtcctaccggccccctcggtcctaccgtccttaccccg

SEQ ID NO: 314265 - DNA, 545 bp, Homo sapiens
  misc_feature: GZ8MTXP02HSGRS.3.71.G05.1.454.CMB.2.raw
  modified_base (368)..(368): a, c, t, g, unknown or other
  misc_feature (368)..(368): n is a, c, g, or t
  modified_base (453)..(453): a, c, t, g, unknown or other
  misc_feature (453)..(453): n is a, c, g, or t
  modified_base (488)..(488): a, c, t, g, unknown or other
  misc_feature (488)..(488): n is a, c, g, or t
tcagagacgcactccacgaccggtgctcgatttagtgtcgtcgcaagagagaggggctgggagaggagccccagccctgagattcccaggtgtttccattcagtgatcagcactgaacacagaggactcaccatggagttgggactgagctggattttcctttggctatttaaaggtgtccggtgtgaagtgcaactggtggagtcgtgggggagcttggtacagcctggcaggtccctgagactctcctgtgcagccctctggattcacctttgatgattatgccatgcacgtgggtccgcaagctccgaaggggagggcctgggagtggggtctcgaggttattacgttggaattagtgaataacngtcggctatgcggactgtgtgaaggccgattcaccatctccagacgacaaacgccaaagacctcctagtatctgacaaatgaacngtactgagacctgacggacacggcttggtattacnggtagtaaaacggtcccggggaaaattacgtaggtaacgttacttttaggaactttc

SEQ ID NO: 314266 - DNA, 628 bp, Homo sapiens
  misc_feature: GZ8MTXP02J14YN.3.71.G05.1.454.CMB.2.raw
  modified_base (235)..(235): a, c, t, g, unknown or other
  misc_feature (235)..(235): n is a, c, g, or t
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
tcagagacgcactccacgaccggtgctcgatttagtgtcgtcgcaagagagagggggcagaagcagagttctggggtgtctccaccatggcctggacccctctctggctcactctcctcactcttgcataggttctgtggtttcttctgagctgactcaggaccctgctgtgtctgtggccttgggacagacagtcaggatcacatgccaaggagacagcctcagaagctattangcaagctggtaccagcaagaagccaggacaggcccctgtacttgtcatctaataggtaaaaaccaccggccctacgagggactccccaagacccgattccncctggcctccagctcgaaggaaccncgacgtccttcctacgaccctactccgacgtcggggcctacgaggggacggaaagagtggacggtctagtacttaattaccgtacgtaacccgtcccgggacaggaccgtaaggttacgtaaacgtagttggtagtaagttacggtacgggggacgggaacgggaaccgtaagggtccggtacccgttaccgtaacggtccgaaccggaccccgtaaagggtccccgtacccggtacccccgttcggtaccctaccgttccgtcccg

SEQ ID NO: 314267 - DNA, 504 bp, Homo sapiens
  misc_feature: GZ8MTXP02JWGC8.3.71.G05.1.454.CMB.2.raw
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (384)..(384): a, c, t, g, unknown or other
  misc_feature (384)..(384): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgcatctataggtaaaaacaccggccctnagggactcccagaccgattctcctggctccagctcaggacncagcttcctgaccntcactggggctcgaggcggaagntgagctgactattactgtaacctcccgggcagcagtgtaacattgtgatagtcggcggacgggaccaagggtcgaccgtctacgtcacgcccgaagcctcgccccctggtccactctccg

SEQ ID NO: 314268 - DNA, 608 bp, Homo sapiens
  misc_feature: GZ8MTXP02JQCHY.3.71.G05.1.454.CMB.2.raw
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
  modified_base (306)..(306): a, c, t, g, unknown or other
  misc_feature (306)..(306): n is a, c, g, or t
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnagaagctatangcaagctggaccagcagaagccaggacaggcccctgtacttgtcatctaataggtaaaaacaccggccctanagggactcccagaccgattcncctgcctccagctacaggaaccncacgtccttcctacgacctatcgacgtcgggctacgagggacggaagagtggacggtactagtaacttaacgttaccgtacgttaacccggtcccgggacacggaccgtaaggtacggtaactagttaggtagtaacgttacggtacgggacgggtaacgggaaccgtaaagggtccgaacccgttaccgtaaccgacgaaccggacccgaacggtcccgtacccgtcccccgtagtaccctaccttcccgttacccg

SEQ ID NO: 314269 - DNA, 526 bp, Homo sapiens
  misc_feature: GZ8MTXP02HGYFV.3.71.G05.1.454.CMB.2.raw
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctattatgcaagctggtaccagcagaagccaggacaggcccctgtactgtcatctataggtaaaaacaccggccctcagggatcccagaccgattcncctgctcagctcagacncagctcctgaccatcacgtgggctcgaggcgaagatgaggctgactattactgtaacctcccgggcagcagtagtacagttgagattagttcggcggtaaagggaccaaagggtcgaacccggttcctaccgtacacggaccccaaagggtcctcggccccctaggtcccaccgttcctcccg

SEQ ID NO: 314270 - DNA, 501 bp, Homo sapiens
  misc_feature: GZ8MTXP02F23WL.3.71.G05.1.454.CMB.2.raw
  modified_base (328)..(328): a, c, t, g, unknown or other
  misc_feature (328)..(328): n is a, c, g, or t
  modified_base (346)..(346): a, c, t, g, unknown or other
  misc_feature (346)..(346): n is a, c, g, or t
  modified_base (421)..(421): a, c, t, g, unknown or other
  misc_feature (421)..(421): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgcatctataggtaaaaacaccggccctcgagggactccccagaccgattcncctgctccagctcagacncagcttctgacatcactgggctcaggcgaagatgaggctgactattactgtaactcccgggcagcagtcgtaacnttgagatagtcggcggacggaccaaggtcgaaccgtccgtacgtcacgcccgaaggcctcgccccctggtccactctccg

SEQ ID NO: 314271 - DNA, 625 bp, Homo sapiens
  misc_feature: GZ8MTXP02HV77Q.3.71.G05.1.454.CMB.2.raw
  modified_base (378)..(378): a, c, t, g, unknown or other
  misc_feature (378)..(378): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttattttaaaaggtgtccggtgtgaagtgcaactggtggagtcgtgggggagcttggtacagcctggcaggtccctgagactctcctgtgcagcctctggattctactttgatgattatcgccatgcacgtcgggccgacaacgctccgaggggacgggccgtgggaggtgggtctcgaggttacttacgtaggaatagtagaattaacngtcggtactagtcggacggtactcgttaggtaggaacgggaccgtacttccgaacctacttcctacccgaagaacgaaccgaaaccgaccaaacgtaacccttaccctacgttactacctagaaccaaagtacgaactagtactagaacgacgtaggacgaccgtacggtaccttagttaacttacgtacgtaagtaaacggtaaccgggtaaattacgtagttacgttagttttacgtactttacg

SEQ ID NO: 314272 - DNA, 565 bp, Homo sapiens
  misc_feature: GZ8MTXP02HY7HG.3.71.G05.1.454.CMB.2.raw
  modified_base (237)..(237): a, c, t, g, unknown or other
  misc_feature (237)..(237): n is a, c, g, or t
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
  modified_base (402)..(402): a, c, t, g, unknown or other
  misc_feature (402)..(402): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcagaagctattangacaagctggtaccagcagaagccaggacacggcccctgtactgtcatctatagtaaaacaccggcctanaggatctcagaccgattcctctgctccagcctacaggaaaccanacgtccttaccttagaacctatccacgtcgggggactcgagggacgaaagngtagacggctagaactagttactcgtaaaccgtcccgggaccaggacagtacggtaaactgttgtagattagttccgggaggacgggacctaaaggtcgtaaccgtaccgtacgtacgaccgaacccgaaggtcctcgacccccgtcggtacctaccgttccg

SEQ ID NO: 314273 - DNA, 513 bp, Homo sapiens
  misc_feature: GZ8MTXP02GKM2N.3.71.G05.1.454.CMB.2.raw
  modified_base (328)..(328): a, c, t, g, unknown or other
  misc_feature (328)..(328): n is a, c, g, or t
  modified_base (350)..(350): a, c, t, g, unknown or other
  misc_feature (350)..(350): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtactgcatctataggtaaaaacaccggccctgaagggactccccagaccgattcncctggctccagctcaaggaacncagtcttcctgaccatcacgtgggctcgaggcgaaagatgaggctgactattactgtaactcccgggacagcagtacggtaacagttgtagatagttcgggacggaagggaccaaagggtcgaccgtctacgcacgcccaaggcctcgcccctgcactctccg

SEQ ID NO: 314274 - DNA, 665 bp, Homo sapiens
  misc_feature: GZ8MTXP02FV28V.3.71.G05.1.454.CMB.2.raw
  modified_base (292)..(292): a, c, t, g, unknown or other
  misc_feature (292)..(292): n is a, c, g, or t
  modified_base (383)..(383): a, c, t, g, unknown or other
  misc_feature (383)..(383): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttcctttggcttattttaaaggtgtccggtgtgaagtgcaacgtggtggagtcgtgggggagcttggtacagcctggcaggtccctgagactctcctgtgcagcctctggacttcactttgatgtattangccatgctacgtgggtccgacacggccgtaccggaggggacgggtccgtgggaggtcgggtctcgtaggttattacgttaggaataggtanataacagtcggactagtcggcgtactcgtggtacggaacgggtcctattacccgaacctacttaccgaaccgaaggaaaccgaccaaaccggaccaaacggtaaccctccgtagttactacgtaacgaactaaacgtcgaaaactcggtacgtacggaaccgtaacgtagggaacggtaaccgtacggttacctttagttaacttacggttacggtaaacggttaaaacccgggtaccggggtaaaattcggtttacgttaacggtttacgtttttaaccgg

SEQ ID NO: 314275 - DNA, 524 bp, Homo sapiens
  misc_feature: GZ8MTXP02IBWLR.3.71.G05.1.454.CMB.2.raw
  modified_base (236)..(236): a, c, t, g, unknown or other
  misc_feature (236)..(236): n is a, c, g, or t
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattangcaagctggtaccagcagaagccaggacaggcccctgtactgcatctataggtaaaaacaaccggccctacgaggactccccaagaccgattcnctggctcagctcagacncagcttcctgaccatcactgggctcgaggcgaagatgaggctagactattactcgtaaacgtcccgggaccagcaacgtggtaacagttggtagagttaagttcggacgggtaacgggaccgaaggtcgaaccgtctacgtcacgcccaaggcctcgccccctggtccacctctccg

SEQ ID NO: 314276 - DNA, 541 bp, Homo sapiens
  misc_feature: GZ8MTXP02JZ1RQ.3.71.G05.1.454.CMB.2.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (342)..(342): a, c, t, g, unknown or other
  misc_feature (342)..(342): n is a, c, g, or t
tcagagacgcactccacgaccggtgctcgatttagtgtcgtcgcaagagagagggggcagaagcagagttctggggtgtctccaccatggcctggaccccctctctggctcactctcctcactcttttgcataggtttctgtggtttcttctgagctgactcagggaccctgctgtgtctgtgggcctttgggacagacagtcaggatcacatgccaaggagacagccctnagaagctattangcaagctggtacccagcagaagcccaggacaggccccctgtacttgtcatctataggtaaaacaaccggccctcgagggatccccagaccgattctccnggcctcagctcagacacagcttccttgaccatcactgggctcaggcgaagatggagctgacttattatcgtaaacctcccggccagcagtggtaacagttgaggattagttcggacgggtaggaccaaagggttcgacccgttaccgtaaccgtcacgcccgtaaggcttaccgcccccgtcggtccacctccttcccg

SEQ ID NO: 314277 - DNA, 593 bp, Homo sapiens
  misc_feature: GZ8MTXP02HBOAV.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggaccagcagaagccaggacacggcccctgtacttgtcatctaatacggtaaaaaccaccggccctacgaagggactcccaagaccgattctcctgcctcagctacaagacacagccttcctgaccatcacgtgggactcgagggacgaagactgagctagactattacgtacgtaaacctcccgggacagccgtagtaggtaaactagttagtagtaagttacggttcgggacggggtaaacgggtacctaaaggggttccgaaccggttacccgtacggtaccgaacggacccgtaaacgggtcctacccggccccccgtaggtcccaacccgttacgtttcccccgg

SEQ ID NO: 314278 - DNA, 651 bp, Homo sapiens
  misc_feature: GZ8MTXP02JYRJL.3.71.G05.1.454.CMB.2.raw
  modified_base (336)..(336): a, c, t, g, unknown or other
  misc_feature (336)..(336): n is a, c, g, or t
  modified_base (367)..(367): a, c, t, g, unknown or other
  misc_feature (367)..(367): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctaattatgcaagctggtaccagcagaagccagacaggccctgtacttgtcatctaatacggtaaaaaaccaccgggtccctgaagggactacccgaagaccgattcnccgtggcctccaagcctacgaagggaaaccncgacgtccttcgtacgacctactcgacgtgggctacgacgggacggaaagtgtaggacggtactagtaacttaacgttaacgtacggttaaacccgtcccgggactaggacgtaaggtacggtaaactagttagtacgtacgttacggtccggggacgggtaacgggtaaccgtaaggggttaccgtaccccggttaccgttaaccgtaccgtaaccggtaaccccgaaaggtccccgttacccggtaccccccgttaggtacccttaccgttcccggttcccg

SEQ ID NO: 314279 - DNA, 523 bp, Homo sapiens
  misc_feature: GZ8MTXP02I6R4M.3.71.G05.1.454.CMB.2.raw
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggaccagcagaagccaggacaggcccctgtactgcatctataggtaaaaaccaccggccctacgaggactcccagaccgattcnctgctccagctacagacncagcttcctgaccatcacgtgggctcgaggcgaagatgaggctagactattacgtgtaactcccgggacagctaagtggtaaacngttganatagtcgggacggaagggacctaaagggtcgaccgtccgtacgtaccagcccgaaggcctacgcccccgtggtacaccgtcttcccg

SEQ ID NO: 314280 - DNA, 582 bp, Homo sapiens
  misc_feature: GZ8MTXP02IKXGW.3.71.G05.1.454.CMB.2.raw
  modified_base (254)..(254): a, c, t, g, unknown or other
  misc_feature (254)..(254): n is a, c, g, or t
  modified_base (354)..(354): a, c, t, g, unknown or other
  misc_feature (354)..(354): n is a, c, g, or t
tcagagacgcactccacgaccggtgctcgatttagtgtcgtcgcaagagagagggggcagaagcagagttctggggtgtctccaccatggcctggacccctctctggctcactctcctcactcttgcataggttctgtggtttcttctgagctgactcaggaccctgctgtgtctgtggccttgggacagacagtcaggatcacatgccaaggagacagcctcagaagctattatgacaagctggacagcagancagacagcccctgtactgcatctaagtaggtaaaacacccggccctacgagggactcccagacccgtattctccgtaggcctccagctacgaacggaacncaagtcctttcctacgaccatcacgtggggactcgagggacgaagatggagctagactattacgtacgtaaaccgtccccgggaccagcgaagtcggtaactagttgtagtagttacgtcggggacggaacgggtaacccgtaaggggtaccgtaacccggtaccgtaccgtaccgacgacccgaaaggcctacccggtccccctcggtaccaccgttccttaccccg

SEQ ID NO: 314281 - DNA, 688 bp, Homo sapiens
  misc_feature: GZ8MTXP02I5JKM.3.71.G05.1.454.CMB.2.raw
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
  modified_base (377)..(377): a, c, t, g, unknown or other
  misc_feature (377)..(377): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctacaagaagcttaattangacaagctggaccagcagacgccgaggacacggcccctgtactgtcatctagtaacggtaaaaccaccggcctacgagggactacccgagaccgtattcctccgtcggcctaccgacgtctaccgaacggtaaccncacgtccttaccgttacgacctatcccgaacgtcggggacctacggaacgggacggtaaagagtcggaacggtcttacggtaaccttaacgtttaccgtacgttaacccggtccccggggtactacggtacgtaacggttaacggttaaacgtagtttaggtacgttagtaacggtttccggggaacggggtaacgggtaaccggtaaacggggtaccgtaaccggttacccgttaccggaccgtaaccgggtacccgaaggtcccgttacccggtcccccgtacggtccctaccgttacccgtttccccg

SEQ ID NO: 314282 - DNA, 923 bp, Homo sapiens
  misc_feature: GZ8MTXP02G4Q42.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaagggagacagccctacgaaggaacgtcttaattagtcgaccaaaggccgtagggtaacccagacaaggaaacgcccgaagggaaccgaccgggccccccttaggttaacctttcggtacctaactttaccgttaaagttaaaccgggtaaaaaaaaccgaaccccgggtacccctaccggaaacggggtaacttacccccgaaacggtaacccgtaactttccgtaccccgttacgggacccttacccgaacggtcccttaaccggaaacgggtaaacccaccgtaacggtacccttttacccgttaacggaaacccttaacgtacccgtaaaccgggttcgggggacccttaccgggaacgggggaacccgggtaaaagggtacgttacgggaacggggtaccgttaacgggtaacctttaaacgtttaaaccgttaccggggttaaaaccccggttacccccgggggaccctaacgggtaccggtaacgggttaacgggttaaaccttaggtttaggtacggttaacgtttacgggttaccggggaaccgggggtaaacggggtaaccgggttaaacggggtaccggtaaccccgggttacccgttaacccggtaccgtaaaccgggacccccgtaaaaggggtcccccgtaacccgggtcccccccgttacggtaccccgtaacccgtttcccgtttacccccggg

SEQ ID NO: 314283 - DNA, 684 bp, Homo sapiens
  misc_feature: GZ8MTXP02H7AUK.3.71.G05.1.454.CMB.2.raw
  modified_base (346)..(346): a, c, t, g, unknown or other
  misc_feature (346)..(346): n is a, c, g, or t
  modified_base (497)..(497): a, c, t, g, unknown or other
  misc_feature (497)..(497): n is a, c, g, or t
tcagagacgcactccacgaccggtgctcgatttagtgtcgtcgcaagagagagggggcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgaccaaggagacagcctcaagaatctatatgcaagctggtaccagcagaagccaaggacacggcccctgtactgcatctaatacggtaaaaaccaaccggtccctacgaagggactacccgaaagacccgtatttccncctggaccctaccagcctacgaaaggaaccacgacgtcctttaccgtacgaacctatccaccgtgggggcctacggacgggaccggaaagtagtacggacggtacgtacgtaaccttaattaccgtaacggttaaacccgtcccccggganaacgccgtaagggttacgtaaactagtttagtagtaacgttaggttaccggggacgggtaaacggggtaccgtaaacggggttccgaaacccggttaccgttaaccggtccgtaacggacccccggtaaagggtcccctaacccgggtcccccccgttagggtaccctaccgtttcccgttccccgg

SEQ ID NO: 314284 - DNA, 571 bp, Homo sapiens
  misc_feature: GZ8MTXP02GEI4C.3.71.G05.1.454.CMB.2.raw
  modified_base (309)..(309): a, c, t, g, unknown or other
  misc_feature (309)..(309): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggagcttggtacagcctggcaggtccctgagactctcctgtgcagcctctggattcacctttgatgattatgccatgcacgtgggtccggnaagctccgaggggaagggcctggagtgggtctccgaggtattacgttggaatagtgataaacagtcggactagtgcggactcgtgtagaagggccgattccacatctccagagaacaaacgacaaagaactccctagtatctagacaaaatgaaacaggtactagacgtacctaggacggaacgaacggccttaggtaattaacttggtaacgtaaaacggtacccgggggaaaattagtaggttaacgtagtttttaacgg

SEQ ID NO: 314285 - DNA, 576 bp, Homo sapiens
  misc_feature: GZ8MTXP02F2EVM.3.71.G05.1.454.CMB.2.raw
  modified_base (270)..(270): a, c, t, g, unknown or other
  misc_feature (270)..(270): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
  modified_base (459)..(459): a, c, t, g, unknown or other
  misc_feature (459)..(459): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttcctttggcttaattttaaaaggtgtccggtgtgaagtgcaactggtggagtcgtgggggagcttggtacagcctggcaggtccctgagactctcctgtgcagcctntggattcactttgatgattatgccatgcacgtgggtccganagctaccgaggggacggcctggagtggtctcgaggtattactggaataganataacatcggactatggcgtactcgtggtaggaacggggcctaattccaacctatcctacagaacgaacaaaccgaccaaagaacctccctagtacnctacgacaaatgaaacagtcngaacgaccngggaagaaccgacggtcctttagtaacgttacgtaggtaagtaaaaccggtccgggtaaaaatgttacgtaacgttagtttttaacg

SEQ ID NO: 314286 - DNA, 695 bp, Homo sapiens
  misc_feature: GZ8MTXP02JTU8N.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctacagaagctattatgacaagctggtaccagcagaacgccaggacacggcccctagtacttgtcatactataacggtaaaaaccaccggccctacgagggactcccgaagacctattctccgtggcctccagtctacgaacgggaaccacacgtccttaccgttagacctactccgaacgtcgggggaccctacggacggggacggaaagacgtacgggaacggtcgttaggtaactttaacgtttaacccgttacgggttaaaccccggttcccccgggggaccgtaaggtacccggtaaagggtttacgggtaaaaccttagtttacggtagtaacgttacgggttacggggacggggtaacgggaaccgtaacggggtcgtaaccccggttaccgtaaccgtaccgacgtaccccggaacggtcccgacccggtcccccgttacggacctacccgttcgttacccccg

SEQ ID NO: 314287 - DNA, 637 bp, Homo sapiens
  misc_feature: GZ8MTXP02HLXJJ.3.71.G05.1.454.CMB.2.raw
  modified_base (341)..(341): a, c, t, g, unknown or other
  misc_feature (341)..(341): n is a, c, g, or t
  modified_base (376)..(376): a, c, t, g, unknown or other
  misc_feature (376)..(376): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtcggtgtgaagtgcaactggtggagtcgtgggggaggcttggtacagcctggcagggtccctgagactctcctgtgcagcctctggattcacctttgatgattatgccatgcacgtgggtccgcaagctccgaggggaacggcgtggagtggtcnccgtaggtattacgtggaatgtagataacatcggntaatggacgtactcgtagtggaacgggccgtattccaccgtactcctaccgaagaacgaaccgaaacccgaccaaaacggtaacccttacccgtacggtacttaccgtacgaacctaaaagtacgaaaaccgtacggtactacggaaacgtacccgtaggaacggaaccgtaccgggtaccctttacgtaacgtttaccgttaggtaacggtaaaacggtacccggggtaaaatacgttacgtaacgtttagttttaacgg

SEQ ID NO: 314288 - DNA, 624 bp, Homo sapiens
  misc_feature: GZ8MTXP02G47U1.3.71.G05.1.454.CMB.2.raw
  modified_base (240)..(240): a, c, t, g, unknown or other
  misc_feature (240)..(240): n is a, c, g, or t
  modified_base (380)..(380): a, c, t, g, unknown or other
  misc_feature (380)..(380): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcgaagaagcttattangacaagctaggtaccagcagaacgccaggacacggcccctgtactgtcatctaagtaacggtaaaaccacccggaccctacgacgggactacccaggaccgtattcctcgtacggcctaccagtcctacgaacggaaccncacgtccttacctacgaccctatacccgagtcggggcctacggagggtacgaaagagtaggacggtactagtacttattaaccgtcggtaaacccggtccccgggacacggtacgtaaggtacgtaaacgtagtttagagtagttaggtcgggacggaacggaccgaaggtccgaccgtaccgtacgtacgaaccggaccgaagtcccgtacccgccccgtacggtcctaccgttccttccccg

SEQ ID NO: 314289 - DNA, 576 bp, Homo sapiens
  misc_feature: GZ8MTXP02IRKHV.3.71.G05.1.454.CMB.2.raw
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (345)..(345): a, c, t, g, unknown or other
  misc_feature (345)..(345): n is a, c, g, or t
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctattatgcaagctggtaccagcagagccaggacaggcccctgtacttgcatctataggtaaaaacaccggcctcgaggatcccagaccgattcncctgctcagctacagacnancttcctgacatcacgtggctgaggcgaaagatgagctagactattacngtaacgtcccggntaagcctaagtaggtaaactagttgtagtaagttacgttcggggaaccggtaaggggaaccctaaagggggttaccgaaacccgggttccctaacggtaccgaaccggacccccgaaaagggtccctaccggtacccccctgggtacccctaaccgtttcgtttcccccg

SEQ ID NO: 314290 - DNA, 497 bp, Homo sapiens
  misc_feature: GZ8MTXP02JA0OU.3.71.G05.1.454.CMB.2.raw
  modified_base (322)..(322): a, c, t, g, unknown or other
  misc_feature (322)..(322): n is a, c, g, or t
  modified_base (338)..(338): a, c, t, g, unknown or other
  misc_feature (338)..(338): n is a, c, g, or t
  modified_base (390)..(390): a, c, t, g, unknown or other
  misc_feature (390)..(390): n is a, c, g, or t
  modified_base (427)..(427): a, c, t, g, unknown or other
  misc_feature (427)..(427): n is a, c, g, or t
tcagagacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtactgcatctataggtaaaaacaccggcctcaggatcccagaccgattcnctgctcagctcagacncagcttctgaccatcactgggctcgaggcgaagatgaggctgactattaacngtaaacgtcccgggacagcgagtggtaaacatttggnatagtcggacggacggacaaaggtcgaccgtcctaacgcacgccaaggctcgcccctggtcacgtctccg

SEQ ID NO: 314291 - DNA, 596 bp, Homo sapiens
  misc_feature: GZ8MTXP02HZ0D2.3.71.G05.1.454.CMB.2.raw
  modified_base (239)..(239): a, c, t, g, unknown or other
  misc_feature (239)..(239): n is a, c, g, or t
  modified_base (356)..(356): a, c, t, g, unknown or other
  misc_feature (356)..(356): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttggggacagacagtcaggatcacatgccaaaggagacagcctcaagaagctattangcaagctgaccagcagaagccaggacaggcccctgtactgtcatctaataggtaaaaaccaccggccctacgaggactcccagacccaattctcgtgcctccagctacaaggaaccncagtccttccttagaccattccacgtggggcctacgacggacggaaagacgtcggaggctagaccttatttacctaggtaaacccgtcccggggacacggtacgtacggtaggtaacaagtttgagtaagttacgtcggggacggtaacgggaacccgtaagggtccgtaccggttaccgtacgtacgaccggacccgaaggtcctccggtacccccgtaggtcccacgttcgttccccg

SEQ ID NO: 314292 - DNA, 594 bp, Homo sapiens
  misc_feature: GZ8MTXP02IEAZM.3.71.G05.1.454.CMB.2.raw
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttcctttggcttattttaaaaggtgtccggtgtgaagtgcaactggtggagtcgtgggggagcttgggtacagcctggcaggtccctgagactctcctgtgcagcctctggattcacctttgatgattatgccatgctacgtggggtcccgcaagcctaccgaggggaacgggcctgggagtcggggtctcgaggtacttacgttaggaattagtgaattaacagttcggactagtggcggactcgtgtgaaggccgtagttcacctatctaccagacgaacaacgaccaaacgacctccctacgtactctacgacaatagaaacagtctagacgacctaggacgacgccggtcttacggtatttaccgtggttaacgtaaacggtaacccgggtaaattagttacgttaacgttacgttttaacggtactttaacg

SEQ ID NO: 314293 - DNA, 562 bp, Homo sapiens
  misc_feature: GZ8MTXP02IUDGR.3.71.G05.1.454.CMB.2.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (401)..(401): a, c, t, g, unknown or other
  misc_feature (401)..(401): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaagganacagcctnagagctattangcaagctggaccagcagaagccaggacacggcccctgtacttgtcatctatacggtaaaaacaccggccctagagggactccccgaagaccgtattctccgtggcctccgagcctacaaggaccacacgtccttcctagaccatcacgtgggctcgaggcgaaagntgacggctgactattacacgtaacctcccgggacagacagtacggtaactagttgagtatacgtcgggacggtaacgggtaccaaagggtccgaaccgttccgtacgtccgaacgtacccgaaggcctaccgcccccgtaggtacctacgttccgttcccg

SEQ ID NO: 314294 - DNA, 578 bp, Homo sapiens
  misc_feature: GZ8MTXP02GZ0CU.3.71.G05.1.454.CMB.2.raw
  modified_base (407)..(407): a, c, t, g, unknown or other
  misc_feature (407)..(407): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctacagaagctattatgacaagctggtaccagcagaagccaggacacggcccctgtactgtcatctaataggtaaaaacaccggccctacgacgggactaccccgagaccgtattctccgtggcctccagctacgaaggacacagtccttacctgaccatcacgtggggcctacgaggacggaagngtaggagactagactagttactcgtaaaccgtcccggacacgacgagtacgtaactagttgtagtagttacgtcgggacggacgggaccgaagggtcgaaccgtccgtacgtaccgacggacccaaagggcctaccggtcccccgtcggtacctaccgttcctttaccccg

SEQ ID NO: 314295 - DNA, 618 bp, Homo sapiens
  misc_feature: GZ8MTXP02G5MWP.3.71.G05.1.454.CMB.2.raw
  modified_base (237)..(237): a, c, t, g, unknown or other
  misc_feature (237)..(237): n is a, c, g, or t
  modified_base (354)..(354): a, c, t, g, unknown or other
  misc_feature (354)..(354): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcagaagctattangcaagctggaccagcagagcagacacgcccctgtactgcatctatacggtaaaacaccggcctagacggtactacccgagaccgatttcctccgtcgcctccagctacaaggaaccncacgtccttacctgaaccatccacgtggggcctacgagggacggaatagtgacggtctagaccttattaccgtcgtaaaccgtccccgggacacggtcgtaacgtacggtaactagtttagtagtacttaacggttcgggaacgggtaacggggtaacccgtaaggggtaccgaacccggttaccgtacggtccgaaccggtacccgaacgggcccgtttccccggacccccggttaggtccctaacccgttccgtttcccccg

SEQ ID NO: 314296 - DNA, 626 bp, Homo sapiens
  misc_feature: GZ8MTXP02HFY6O.3.71.G05.1.454.CMB.2.raw
  modified_base (309)..(309): a, c, t, g, unknown or other
  misc_feature (309)..(309): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctacagaagctattatgcaagctggtaccagcaagaagccaggacaggcccctgtactgtcatctataggtaaaaacaccggccctanaggactcccagaccgattctcctgcctcagctcaagacacacgcttcctgacctatccacgtggggacctcgagggacggaaagagtgaggctaggaactattaaacgtgttaaacccgtcccggggtacacggtaccgtaaggttacggtaaaacctgtttaggtacgtaagtttacgttacgggggaccgggtaacggggtaacccgtaaaggggttccggaacccgttacccgtaacggtaccgaacggaccccctaaagggggtccctaccggtccccccgtacgggtccctaaccggtttacccttccccgg

SEQ ID NO: 314297 - DNA, 751 bp, Homo sapiens
  misc_feature: GZ8MTXP02GTT8X.3.71.G05.1.454.CMB.2.raw
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacaggacagtcaggatcacatgccaagganacagcctcagaagctattagngacaagctaggtaccagacaagacgccgaggacgaccggccctagtactcgtactactactaagtaaacggtaaaaccgacccggtacctacgaacggtacctacccgaacgtaccgtacttctccgtcgacctaccgacgtacctaacgaaacggaaccacgtacgtccttaccgtacgaacctacgtaccgtaacggtcgggtacctacggaacgggtacggaaacgtacgtacgggacggtacgtaacgtaacgttaacgtttaaccggtaccggttaaacccggtaccccgggtacgtaacggtacggtaacggttacggttaaacgttaggtttacgtaacggttaacgttacggttacggggacgggtaaacggggtaaaccggtaaacgggtaccggtaacccggttacccgttaaccgtaccgtaacccggtaacccggtaacggtcccgtacccggtacccccgttaccggttacccgtttacccggtttacccggtacccccg

SEQ ID NO: 314298 - DNA, 574 bp, Homo sapiens
  misc_feature: GZ8MTXP02GO6OB.3.71.G05.1.454.CMB.2.raw
  modified_base (330)..(330): a, c, t, g, unknown or other
  misc_feature (330)..(330): n is a, c, g, or t
  modified_base (350)..(350): a, c, t, g, unknown or other
  misc_feature (350)..(350): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctaattatgacaagctggtaccagcagaagccaggacacggcccctgtactgcatctataggtaaaaacaccggcctacgagggactcccagaccgattcnctggctcagctacaggaacncagtcttcctgaccatcacgtgggctcgaggcggaagatggagctagactattacgtcgtaaaccgtccccgggacagcctaggtacggtaaacagtttgtagtattaacgttcggggacgggtaacggggaacccgtaaaggggtcgaacccggttcctacggtaccgaacgaccccgaaagggccctaccggccccccgtggtaccacccgttcgttccccg

SEQ ID NO: 314299 - DNA, 742 bp, Homo sapiens
  misc_feature: GZ8MTXP02IET46.3.71.G05.1.454.CMB.2.raw
  modified_base (227)..(227): a, c, t, g, unknown or other
  misc_feature (227)..(227): n is a, c, g, or t
tcagagacgcactccacgaccggtgctcgatttagtgtcgtcgcaagagagagggggcagaagcagagttctggggtgtctccaccatggcctggaccccctctctggctcactctcctcactctttgcataggttctgtggttttcttctgagctgactcaggaccctgctgtgtctgtggccttgggacagacagtcaggatcacatgaccaaggagacagcctnaagaagctatatgacaagctggtaccagcagaagccaaggacacggcccctgtactgtcatctaataaggtaaaaaccaaccggccctacgaacgggactaccccgaagaccgtattcctacccgtcggcctcccgagtctaccgaagggaaacccacgtaacgtcccttttacccgttacgaacccctatacccgtaacgttcgggggacccttacgggaacggggaccggaaaagtacgttagggacggttaccgtagggtaaaccttaagttaaaccgttcggttaaaacccggtccccggggtaacacgggtacgtaacggttagggttaaaacctagtttagggtagtaacgttagggttaccggggaacggggtaacggggaaccccgtaaaaggggttccgtaaaccccggttaccttaaccggtccgaaacccgaccccggtaaacggtccccgttcccggaccccccggtttcggtacctaaccccgtttaccgtttccccccggg

SEQ ID NO: 314300 - DNA, 548 bp, Homo sapiens
  misc_feature: GZ8MTXP02JSZHY.3.71.G05.1.454.CMB.2.raw
  modified_base (330)..(330): a, c, t, g, unknown or other
  misc_feature (330)..(330): n is a, c, g, or t
  modified_base (452)..(452): a, c, t, g, unknown or other
  misc_feature (452)..(452): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctatatgcaagctggtaccagcagaagccaggacacggcccctgtacttgcatctaataggtaaaaacaccggcctacgaggactcccgaagaccgattcncctgctccagctcaaggaccacagtcttcctagaccatcacgtgggctcgaggacggaagatcgagctgactattacgtcgtaaaccgtcccgggacacgacgagtaggtaaactagttagngtaatacgttacgggacggacggaccgtaaggtcgacccgtacgtaccgtcaacggcccgaaggtccctccgccccgtcggtccaccttcctcccg

SEQ ID NO: 314301 - DNA, 604 bp, Homo sapiens
  misc_feature: GZ8MTXP02I4M0V.3.71.G05.1.454.CMB.2.raw
  modified_base (361)..(361): a, c, t, g, unknown or other
  misc_feature (361)..(361): n is a, c, g, or t
  modified_base (590)..(590): a, c, t, g, unknown or other
  misc_feature (590)..(590): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgacaagctggaccagcagaagccaggacacggcccctgtactgtcatctatacggtaaaaacaccggccctacgaggactaccccagaccgtattcctccgtagcctccagctacgaacggaacnccagtcctttcctacgacctatccgaaccgtggggctaccgaagggacggtaaacgatggaaggctaagacttacttaacgtacgttaaacccgtcccggggacacggacgtaaggtacgtaactagttggtatagttacgtcgggacgggaacggtacgaaagggtcgtaacccgtaccgtaccgtacgaccgacccgaacggccctaccggacccccgtcggtaccnccgttcgtaccccg

SEQ ID NO: 314302 - DNA, 595 bp, Homo sapiens
  misc_feature: GZ8MTXP02FTRB7.3.71.G05.1.454.CMB.2.raw
  modified_base (369)..(369): a, c, t, g, unknown or other
  misc_feature (369)..(369): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttcctttggctaattttaaaaggtgtccggtgtgaagtgcaactggtggagtcgtgggggagcttggtacagcctggcaggtccctgagctctcctgtgcagcctctggattcacctttgatgattatgccatgcacgtgggtccgcaagctccgaggggagggcctgggagtgggtctcgaggttacttacgttggaaatagtgaataacngtcggctagtcgcggtactcgtgtagagggccgtattaccaccaattccacccaagacgaacaaccgaccaaagaacctccctagtactctagaacctaaagtacgaacagtactgaacgtccgtaggaacggacgaaccggtccttagtaacttacgtaggtacgttaaaaccggtaacccgggtaaaattagttacggtacgttaagttttacggaactttacg

SEQ ID NO: 314303 - DNA, 578 bp, Homo sapiens
  misc_feature: GZ8MTXP02F13AD.3.71.G05.1.454.CMB.2.raw
  modified_base (370)..(370): a, c, t, g, unknown or other
  misc_feature (370)..(370): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttcctttggctattttaaaaggtgtccggtgtgaagtgcaactggtggagtcgtgggggaggcttggtacagcctggcaggtccctgagactctcctgtgcagcctctggattcacctttgatgattatgccatgcacgtgggtccgcaagctccgaaggggacggcctgggagtggggtctcgaggtacttacgtggaaatagtgaataacngtcggctagtgcggactctgtagaacgggccgtattcacctatctccgaagacgaaccaaccgaccaaagaacctccctagtactctagacaaagtcgaaactagtactgaacgtacctggaacgaccgaacggtccttagtaacttacgtagtagtaaaacggtaaccggggtaaatacgtagtacgttagtttacggaactttacg

SEQ ID NO: 314304 - DNA, 675 bp, Homo sapiens
  misc_feature: GZ8MTXP02IH2QQ.3.71.G05.1.454.CMB.2.raw
  modified_base (351)..(351): a, c, t, g, unknown or other
  misc_feature (351)..(351): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcaagaagctattatgacaagctggtaccagcaagaagccaaggacacggcccctgtacttgtcatctataggtaaaaacaccggccctagaggactcccagaccgatctctgcctcagctcaagacncagccttcctagaccatcacgtggggcctacgaggacggaaagtagtaggacggtctaggaacttaagttaaccgtaggtaaacccgtccccggggaacctaggacccgtaaaggttacggttaaaacctagtttcggtagtaaagtttacgggttaccgggggaaccgggttaacgggggaaaacccctaaagggggttaccgtaaacccccgggtttacccgttaaacccgggttccgaaaccgggacccccgtaaaacgggtccctaccccggtacccccccgtagggttacccctaaccgtttccccgtttacccccggg

SEQ ID NO: 314305 - DNA, 743 bp, Homo sapiens
  misc_feature: GZ8MTXP02HL74L.3.71.G05.1.454.CMB.2.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (371)..(371): a, c, t, g, unknown or other
  misc_feature (371)..(371): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagggtcaggatcacatgccaagganacagcctcagaagctattangcaagctggaccagcagaacgccaaggacacggcccctgtacttgtctatttagaggtaaaaaccaccggccctagacgggactcccgagaccgtattcctcgtcggcctaccagcctacgaaacggaaaacnctaagtcctttacccgttagaacccctatccgaaccgttcgggggccttaccggaaggggaccgggaaaagtacgttacgggaacggggtccttagggtaaccttaacgtttaccgttaacggttaaaccccgttccccgggggacctaaggccgtaaagggttacggtaaaacctgtttacggtaggtaacttaggttccggggacgggtaaacgggggaacccgttaaaaggggttccggaaaccccggtttccgttaaaccggtccgtaaaaccgggacccccgtaaaaggggtccccgttacccgggacccccccgtttacgggtaccccttaaccgtttccccggtttacccggttttcccccccgg

SEQ ID NO: 314306 - DNA, 610 bp, Homo sapiens
  misc_feature: GZ8MTXP02GA6DJ.3.71.G05.1.454.CMB.2.raw
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
  modified_base (376)..(376): a, c, t, g, unknown or other
  misc_feature (376)..(376): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggctattttaaaaggtgtccggtgtgaagtgcaactggtggagtcgtgggggagcttggtacagcctggcaggtccctgagactctcctgtgcagcctntggattcacctttgatgattatgccatgcacgtcgggtccganagcgtccgaggggaacgggccgtggaggtgggtctcgaggtacttacgttaggaataggtgaattaacngtcgggacttagtgtacgacttcgtgtaggaacgggaccgacgttacactactctaccgaagaacgaaccaaacgacccaaacgaacctccctagtactctagacaaactacgactagtacagtaacgaccgtaggaacggacgtacggtcccgtttagtacttacgtacgtacggttaaacggtaaccggggtaattaagttacggtaagtttagttttacggaactttaccg

SEQ ID NO: 314307 - DNA, 553 bp, Homo sapiens
  misc_feature: GZ8MTXP02J2W4Y.3.71.G05.1.454.CMB.2.raw
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
  modified_base (383)..(383): a, c, t, g, unknown or other
  misc_feature (383)..(383): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaanctattangcaagctggtaccagcagagccaggacacggcccctgtacttgtcatctaataggtaaaaaccaccggccctnagggactcccaagaccgattcncctggctcagctcagacncagctctgaccatcacgtgggctcgaggcggaantgaggctagacttatacgtgtaaaccgtcccgggcaagctagtcgtaacattggtagacttagtcgggacggtacgggaacccgtaagggtacgacccgtacctacgtaccgaacggtaccccgaaggtccgtaccgccccccgttacggccctaaccgttcctccccgg

SEQ ID NO: 314308 - DNA, 653 bp, Homo sapiens
  misc_feature: GZ8MTXP02JE2DJ.3.71.G05.1.454.CMB.2.raw
  modified_base (312)..(312): a, c, t, g, unknown or other
  misc_feature (312)..(312): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttattttaaaaggtgtccggtgtgaagtgcaactggtggagtcgtgggggaggcttggtacagcctggcaggtccctgacgactctcctgtgcagcctctggtacttcacctttgatgtattatgccatgcacgtcgggtccgnagctacgagggaacgggcctggagtgggtctacgtaggttattacgttaggtaaattaggtgtaataacgagtcggacttagtcggcgtactcgtggtaggaacgggccgtactacgacctactactaccaacggaacgaaccaaaccgaccaaacgtaacctacccgtacgtactcgtagaactaaatacgaaacgtacgtacgtacgaacgtaccgtaggaacggaccgtacggtaccgttagttaacgttacgttacggtaacggttaaaaccggtaaccgggggtaaaacttaaggttacggttaacgtttaacgttttaacggtaaccttttaacg

SEQ ID NO: 314309 - DNA, 589 bp, Homo sapiens
  misc_feature: GZ8MTXP02JC6V5.3.71.G05.1.454.CMB.2.raw
  modified_base (349)..(349): a, c, t, g, unknown or other
  misc_feature (349)..(349): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagagccaggacaggcccctgtactgcatctataggtaaaaaccaccggccctacgagggactccccgagaccgattcctcctgctcagctcaagacncagcttcctgaccatccacgtggggctcgaggacgaagatgaggctgactagttactacgtaaccgtcccgggacaggcctaagtacggtaaactagtttgaggtattagttcggggacgggtaacggggaaccgtaaggggtaccgaaacccggttcccgtaaccgtaccgacggaaccccgaacgggtcccttcccggaccccccgttagggtccctaacccgtttccgtttaccccg

SEQ ID NO: 314310 - DNA, 602 bp, Homo sapiens
  misc_feature: GZ8MTXP02I6I30.3.71.G05.1.454.CMB.2.raw
  modified_base (391)..(391): a, c, t, g, unknown or other
  misc_feature (391)..(391): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttcctttggctattttaaaaggtgtccggtgtgaagtgcaactggtggagtcgtgggggaggcttggtacagcctggcaggtccctgagactctcctgtgcagcctctggattcacctttgatgtattatcgccatgcacgtcggggtccgacaacggtccgtaccgaagggggaacgggtccgtgggtaggtcggggtctcgtaggttacttacgttggaatagtgaataacngtcggactagtgcgtactcgtggtaggaacgggtccgtattaccgacctactctacccagacgaacaaaccgccaaagacctcctagtactctgaccaaagtcgaactagtactgaacgacctaggacggacgacggtccttagtaattaccgtagtacgtaaaacggtccgggtaaatagttacgtacgttagttttacggaactttacg

SEQ ID NO: 314311 - DNA, 747 bp, Homo sapiens
  misc_feature: GZ8MTXP02JN2FG.3.71.G05.1.454.CMB.2.raw
  modified_base (336)..(336): a, c, t, g, unknown or other
  misc_feature (336)..(336): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctacagaagctattatgacaagctggtaccagcaagaacgccaggacacggcccctgtactgtcatctatacggtaaaacaccggcctacgaggactacccgagaccgaatcnccgtcgcctcagtcacgaacggacacgactccttaccttacgacctactccgtaaccgtcgggggtacctaccggaaggggaccggaaaggagttacgggaacgggtcgttaagtaaacgttacgtttaaccggtacggtaacggtaccccggttaaccccgggggaaaacctaaccgggtaaacgttaccgggttaaaacccgtagggtttacgggttaacgggtttaaccgggttaccgggggaacggggtaaaacccggggtaaaacccgttaaaaccggttaccggtaaacccccgggttaaccggtaaacggttacccgaacccgggtaaccccgtaaaccggggccgtccccggtaccccccgttacggtcctaacccgttcccgtttcccggtttaaccccccg

SEQ ID NO: 314312 - DNA, 564 bp, Homo sapiens
  misc_feature: GZ8MTXP02G1IVR.3.71.G05.1.454.CMB.2.raw
  modified_base (387)..(387): a, c, t, g, unknown or other
  misc_feature (387)..(387): n is a, c, g, or t
  modified_base (479)..(479): a, c, t, g, unknown or other
  misc_feature (479)..(479): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtcgtgggggaggcttggtacagcctggcaggtccctgagactctcctgtgcagcctctggactcaccttcacgctcaatcggccactacgtggactggggtcccgccgaggcctcccgaggggaaggggcgtggggaggtggggttggccccgtttcgtagagacacaactaacngtacgacaccgacacaataccgccgcgtctaggtagaaagggcaagacttccaccatcctacaagagatgattcagtagaactctactttanccttagactaaatcgaaactacgcctaggaacgaaccggacgaccgacgccgtactaagttactggtctacatacgaccttaagg

SEQ ID NO: 314313 - DNA, 657 bp, Homo sapiens
  misc_feature: GZ8MTXP02FL08W.3.71.G05.1.454.CMB.2.raw
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (386)..(386): a, c, t, g, unknown or other
  misc_feature (386)..(386): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttattttaaaggtgtccggtgtgaagtgcaacgtggtggagtcgtgggggagcttggtacagcctggcaggtccctgagactctcctgtgcagcctntggattcacctttgatgattancgccatgacacgtcgggtccgacaagcctaccggaggggaacggcctaggaggtcgggtctcgtaggttactttacgtaggaaataggtagaactaacngtcgggacttagtcggcgtactcgtaggtaggaaacgggccgtattaccgacctatcctaccgagaacgaccaaaccgaccaaacgacccttacccgtagtaactcgtacgaactaaaacgtaggtaaactacgttacgtaggaacgtacccgtaagggaacggtaccgtaccggtacctttaggttaacttaccgttacggttacggttaaaaccggtaaccggggttaaatacgttaggttacgtttaggttttacggtaactttaacg

SEQ ID NO: 314314 - DNA, 633 bp, Homo sapiens
  misc_feature: GZ8MTXP02IZR6H.3.71.G05.1.454.CMB.2.raw
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaacgccaggaccaggcccctgtacttgcatctatacggtaaaacaccggcctacgaggactcccagaccgattcnctgctcagctcaagacncganccttcctagacatcacgtgggctacgaggcggaagagtggaggctagacttattaacgtcgtaaaccgtccccgggtacaaggccgtaaggtacggtaaactagtttggacggtaattacggttaccggggacggggtaaacggggtaaccgtaaagggggttaccggtaaccccggttacccgtaaccgggttacccgaaccggtacccccggaaaagggtccccgtacccggtacccccccgttcggggttacccctaaccgtttacccgtttacccccgg

SEQ ID NO: 314315 - DNA, 638 bp, Homo sapiens
  misc_feature: GZ8MTXP02IKJ0S.3.71.G05.1.454.CMB.2.raw
  modified_base (285)..(285): a, c, t, g, unknown or other
  misc_feature (285)..(285): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggcttaattttaaaaggtgtccggtgtgaagtgcaactggtggagtcgtgggggagcttggacagcctggcaggtccctgagactctctgtgcagcctctggattcactttgatgattangccatgcacgtcggtccgacaacgcgtaccggaggggaacgggtccgtagggagttgggtcctacggtaggttactttacgttaggaattacggtagaattaacagtccggattacgtcggaccgtactgtagggtagaacgggcccgtaatccgacctatcctaccgaagacgaaaccaaccgaccgaaactacccttacctagtaactcgtagaaaccaaagttgaaactagtactagaacgtacgtaggaacggacgtacggtcctttagaactttcgtacggttaagaaaccgggttaacggtaaattacgttacggtaaacgtttacgttttacggaaactttttacg

SEQ ID NO: 314316 - DNA, 556 bp, Homo sapiens
  misc_feature: GZ8MTXP02JUULK.3.71.G05.1.454.CMB.2.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (426)..(426): a, c, t, g, unknown or other
  misc_feature (426)..(426): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnagaagctattangcaagctggtaccagcagaagccaggacaggcccctgtacttgcatctataggtaaaaaacaccggccctacgaagggactccccgaagacccgattctcctgctccagctcaggacacagcttctgaccatcacgtggggctcgaggcggaaagagtgaaggctgaaccttattaacgtcgttaaaccnccccggggacaagccgaaggtcggtaaacatttgaggattaagttcgggacggtaacgggacccaaagggttcgacccgttcctaacgcaacggcccaaaggcctacgccccctggtcccacctcgtccg

SEQ ID NO: 314317 - DNA, 614 bp, Homo sapiens
  misc_feature: GZ8MTXP02FMSQA.3.71.G05.1.454.CMB.2.raw
  modified_base (310)..(310): a, c, t, g, unknown or other
  misc_feature (310)..(310): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttcctttggctattttaaaaggtgtccggtgtgaagtgcaactggtggagtcgtgggggaggcttgggtacagcctggcaggtccctgagactctcctgtgcagcctctggattcacctttgatgattatgccatgcacgtgggtccgnagctacgagggaacggcctggagtgggtctcgaggttattacgttggaattgtagataacatcggactagtgacgggtactcgtgtaggaacgggtccgtattccaccagtcctaccgaaggagaccaaacgacccaaagtaaccctccctagtaatctagacaaaagtcgaaacagtacctgaaacgtaccgtaggacggtaaccgtaccggtccgtttaagttacgtttaaccgtggttaaacggtaaaacgggtaacccgggggtaaaattaggtacgttaaaccggttagtttttaacgg

SEQ ID NO: 314318 - DNA, 619 bp, Homo sapiens
  misc_feature: GZ8MTXP02HJZUO.3.71.G05.1.454.CMB.2.raw
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
tcagagacgcactccacgaccggtgctcgatttagtgtcgtcgcaagagagaggggcagaagcagagttctgggtgtctccaccatggcctggacccctctctggctcactctcctcactctttgcataggttctgtggtttcttctgagctgactcaggaccctgctgtgtctgtggccttggacagacagtcaggatcacatgccaagganacagcnagaanctatangacaagctgacagcaagaacncagacacgccctagtactgtacatactaagtaacggtaaaaaaccacccggtcctagaagggactaccccgaaagaccgtattcctacccgtcgacctaccgacgacgtacgaaacggaacgaacacgtaccttaccgttacgtacctaactacgacgtacgggacgtacgacggacggaagagtagaggacgtacgtacgtaacgttaactacgtaaccgtacccggtaccgacgacgacgtagtaaacgtaagttagtagtagtacgtacggtacggaacgggaacggaacggtacgtaccgtaccgtaccgtacgaccgaccgaacgaccgtaccgtccccgtaccgtaccgtacctaccgtccg

SEQ ID NO: 314319 - DNA, 584 bp, Homo sapiens
  misc_feature: GZ8MTXP02JO3SC.3.71.G05.1.454.CMB.2.raw
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttccttttggctattttaaaaggtgtccggtgtgaagtgcaactggtggagtcgtgggggagcttggtacagcctggcaggtccctgagactctcctgtgcagcctctggacttcacctttgatgtattatcgccatcgctacgtgggtcccgacaagctaccggaggggaggccgtggaggtcgggtctcgtaggtacttacgtaggaatagtagataaacagtcggtctagtcggcgtactcgtgtaggacgggcctattacccgactactcctaccgagacgaaccaaaccgaccgaaacgaaccctacctagtactactacgaacaaagtacgactagtcagacgtacgtaggacgacgacgtcttacgtacttacgtagtaagtaacggtacgggtaatgtacgttacgtatttacg

SEQ ID NO: 314320 - DNA, 683 bp, Homo sapiens
  misc_feature: GZ8MTXP02HTO9B.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctacagaagctattatgacaagctggtaccagacaagaagccaggacacggcccctgtactgtcatctaatacgtaaaacaccggccctagacgggactcccgagaccgtattcctccgtcgtcctccgacgtcctaccgaacggaaccacgtacgtcctttacccttacgaaccctatccgaaccgtgggggaccctacggaacgggacggaaagtagtcgggaacggtcgtagtaacttaacttacgttaccggttaaacccgtaccccgggggacacggtaccggtaaggtacggtaaacgtagttacggtagtaacgttacggttacggggacggggtaacgggaaacccgtaaaggggttccgaaacccggttacccgtaacggtaccgaaccggacccgtaaacgggtcccgtccggtaccccccgtcgggtccctaccgttcccgtttaccccgg

SEQ ID NO: 314321 - DNA, 676 bp, Homo sapiens
  misc_feature: GZ8MTXP02GIW7G.3.71.G05.1.454.CMB.2.raw
  modified_base (238)..(238): a, c, t, g, unknown or other
  misc_feature (238)..(238): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcaagaagctattangacaagctggaccagcagacgccaggacacggcccctgtactgtcatctaataacggtaaaaaccaccggccctagacggactacccgaagaccgtacttcctccgtcggcctaccgacgtcctacgaaacggaaccacacgtccttaccgtacgaaccctagtcccgtaacggtcgggggtaccctacggaacggggaccggaaaagtagtacgggacggtacgttacggtaaacttaacgttaaccgttacggtaaacccggtccccggggactacggacgtaacggttaacgtaaacgtagtttaggtagtaagttacggtacgggggacgggtaaacgggaccggtaaagggtccgtaaacccggttcgtaccgtacgaccgacccgtaaggtccctccggacccccgttacggtcctacctaccgtttccccg

SEQ ID NO: 314322 - DNA, 549 bp, Homo sapiens
  misc_feature: GZ8MTXP02GKFIC.3.71.G05.1.454.CMB.2.raw
  modified_base (308)..(308): a, c, t, g, unknown or other
  misc_feature (308)..(308): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttcctttggctattttaaaaggtgtccggtgtgaagtgcaactggtggagtcgtgggggaggcttggtacagcctggcaggtccctgagactctcctgtgcagcctctggattcacctttgatgattatgccatgcactgggtccgnaagctccgaggggagggcctgggagtgggtctccgaggtattactggaaatagtgataacagtcggactatgcggactctgtgagggccgattcacatctccagacgacaaacgaccaaacgaactaccctgtactactacgacaaatagaaacagtactagacgaccgtagacggacaacggccttagtactacgtagtaagtaaacgtaccgggaaatagtagtacgtagttttaacgg

SEQ ID NO: 314323 - DNA, 621 bp, Homo sapiens
  misc_feature: GZ8MTXP02JNYXZ.3.71.G05.1.454.CMB.2.raw
  modified_base (220)..(220): a, c, t, g, unknown or other
  misc_feature (220)..(220): n is a, c, g, or t
  modified_base (330)..(330): a, c, t, g, unknown or other
  misc_feature (330)..(330): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacngcctcagagctatatgacaagctggaccagacagacgcaggacacgccctagtactgtacatactagtaacggaaaaccaccggcctacgacgggactcccgagaccgtntctccgtgcctacacgcacgaagaaccacgtactaccttaccgtagacctacacgacgtcgggacctacgacgggtacggaagtagtcggacgtactaggtaacttacgttaacgtaccgtaacccgtaccccgggacaggtactaaggtacgtaactagttagtactagttacggtacgggacggtaacggaaccgtagggtaccgtaccgttacgttaccgaccgtaccgacccggtaacgtcccgtacccggtccccttacgggtaccctaccgttcccgttccccgg

SEQ ID NO: 314324 - DNA, 570 bp, Homo sapiens
  misc_feature: GZ8MTXP02GK9EE.3.71.G05.1.454.CMB.2.raw
  modified_base (224)..(224): a, c, t, g, unknown or other
  misc_feature (224)..(224): n is a, c, g, or t
  modified_base (399)..(399): a, c, t, g, unknown or other
  misc_feature (399)..(399): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnagaagctattatgacaagctggtaccagcaagaacgccaggacacggcccctgtacttgtcatctaagtaacggtaaaaaccaccggcctacgacggactacccaagaccgattctccgtgctcagctacagacacacgtccttctcgacatcgacgtgggctcgaggcgaaagngtggagtctgaactattacgtacgtaaccgtcccgggacagccgtaagtacgtaactagttcgtagtagttacgtcgggacgggtacggaccgtaggtccgtaccgtaccgtacgtacgaaccgcccgaaggtccgtaccgcccccgtacggtcctaccgtccgtttcccg

SEQ ID NO: 314325 - DNA, 609 bp, Homo sapiens
  misc_feature: GZ8MTXP02HO643.3.71.G05.1.454.CMB.2.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (479)..(479): a, c, t, g, unknown or other
  misc_feature (479)..(479): n is a, c, g, or t
  modified_base (504)..(504): a, c, t, g, unknown or other
  misc_feature (504)..(504): n is a, c, g, or t
tcagagacgcactccacgaccggtgctcgatttagtgtcgtcgcaagagagagggggcagaagcagagttctggggtgtctccaccatggcctggacccctctctggctcactctcctcactcttgcataggttctgtggtttcttctgagctgactcaggaccctgctgtgtctgtggccttgggacagacagtcaggatcacatgaccaaggagacagccctnaagaagctattangacaagctggaccagcagaacgccaggacacggcccctgtacttgctatctaagtaacggtaaaaaaccaccggccctacgaacgggactaccccgagtaacccgtattcctccgtcggcctccgacgtctacaaaggaaccacgtaagtccttccttacgaacccaagttccaacgttcggggacctacgaacgggacggaaagatggaaggtctagaccttaattacgttacgtaaccncccgggtacagtacgaagtagtaanagttgcgtatagtcggacggaacggaccgaaagggtcgtaaccgttcgtacgaccgacgacccgaacggtctcccggtaccccctggtccaccgtttctccccgg

SEQ ID NO: 314326 - DNA, 602 bp, Homo sapiens
  misc_feature: GZ8MTXP02HHCP5.3.71.G05.1.454.CMB.2.raw
  modified_base (284)..(284): a, c, t, g, unknown or other
  misc_feature (284)..(284): n is a, c, g, or t
  modified_base (485)..(485): a, c, t, g, unknown or other
  misc_feature (485)..(485): n is a, c, g, or t
  modified_base (528)..(528): a, c, t, g, unknown or other
  misc_feature (528)..(528): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggctattttaaaaggtgtccggtgtgaagtgcaactggtggagtcgtgggggagcttggtacagcctggcaggtccctgagctctcctgtgcagcctctggattcactttgatgattangccatgcacgtcgggtccgacaagcctaccggaggggaacgggccgtgggaggtcgggtctctatcccctagttagtagtagtagttagttacataatactacgacagactcagtagaacggtcctatccaacatcctaccgaagacgaacaaccgaccaaagtacctacacgtatactctaagaaccaaaagtcgaaacncggtaccgtagacggaaccgaccggaaacggaccgtaccggtnttacggtacgttaacttacgtggtaaggtacggtttagggttttgggttacgggggcggtaacgtacgggccgg

SEQ ID NO: 314327 - DNA, 666 bp, Homo sapiens
  misc_feature: GZ8MTXP02HKLV7.3.71.G05.1.454.CMB.2.raw
  modified_base (283)..(283): a, c, t, g, unknown or other
  misc_feature (283)..(283): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggatttcctttggctattttaaaaggtgtcggtgtgaagtgcaatggtgagtcgtgggggagcttggtacagcctggcaggtcctgagactctctgtgcagcctctggattcactttgatgacttangcatcgcacgtcgggccgacaacgctacggaggggacggtcgtaggtaggtcggtctacgtaggttattacgtaggaatagtagtactaaacgagtcgtatagtcggaccggtactcgtaggtacggaacgggtccctaattacccaaccgtactcctaccgaaagaccgaaaccgaaaccgaaccgtaaaacgtaaccccttccgtagtaacctacgaacgaaactaaaagtaacgaaacgtaacgtacgtacgaacgtaaccgtacggaacggaacgtaccggtaccgttacgttacgttaacgttacggttaacggttaaaacgggtaaaccgggtaaaacggttaaacgttaacggttaacggtttaacggtttaacgg

SEQ ID NO: 314328 - DNA, 752 bp, Homo sapiens
  misc_feature: GZ8MTXP02GBM9G.3.71.G05.1.454.CMB.2.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (234)..(234): a, c, t, g, unknown or other
  misc_feature (234)..(234): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggttcttctgagctgactcaggaccctgctgtgtctgtggccttgggacagacagtcaggatcacatgccaagganacagcctnagaagctatangcaagctggaccagcagagcaggacacggcccctgtacttgctatcgtaagtacggtaaaaaccaccggtcctagagggactacccgagtacccgtatttccgtacctcgggaccttacgacgtccttaccgaaacgggtaaccctacgacggtacctttacccgttagaaccctagttacccgaaccgttgggggtacccttacggaacggggtaccggtaaacgtacgttacgggaacggtaccttaggtaaaccttaacgtttacccggtaggttaaaccccgtccccgggggtactaagggtacccgttaacggttacggttaaaaccgttagtttacggttaacggtaaacgtttacggtttaccgggggaacggtaaacggggtaacccgttaaacggggttcgtaaccccggttaccgtaaaccggttaccgaacggtaccccgtaaaacggggccctttacggacccccccggttagggttacctacccggtttaccgtttaacccccgg

SEQ ID NO: 314329 - DNA, 613 bp, Homo sapiens
  misc_feature: GZ8MTXP02HZE7Z.3.71.G05.1.454.CMB.2.raw
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttcctttggctattttaaaatgtgtccggtgtgaagtgcaactggtggagtcgtgggggaggcttggtacagcctggcaggtccctgagactctcctgtgcagcctcgtggattcaccttgatgattatgccatcgcacgtcggggtccgcaagcgtaccgagggacgggtcctgggagtgggtctcgtaggtatttacgtggaaatgtagaatacgagtcggactagttcggcgtacttcgtgtaggtacgggtaccgtagttccactactaccctaccacgaacgaaccgaaaccgacccgaaacgtacctaccctagtactctacgaacaaagtacaaacgtacgtacctagacgacctaggacggaccgtacggtaccttaggttacttaccgtggtaagtaaacggtaccggggtaaacttacggtagttacgttagttttacggttaaac

SEQ ID NO: 314330 - DNA, 654 bp, Homo sapiens
  misc_feature: GZ8MTXP02GNW9I.3.71.G05.1.454.CMB.2.raw
  modified_base (239)..(239): a, c, t, g, unknown or other
  misc_feature (239)..(239): n is a, c, g, or t
tcagagacgcactccacgaccggtgctcgatttagtgtcgtcgcaagagagagggggcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgaccaaggagacagcctacagaagctattangacaagctaggtaccagacagaacgccaggacacggcccctgtacttgcatctaataacggtaaaaaccacccggccctacgagggactccccgaagaccgtattcaccgtcgcctccagcctacgaacgaccacacgtccttcctagaccatccacgtggggacctacggaacgggtacggaaagtagtacggaacgggtctacgtaaccttaacgttaaccggtaccggtaaaccccgtccccggggtaacacggtaccggtaagttacggttaaactagtttaggtagtaagttacggtaccgggggaacgggtaaacgggaccggtaagggtacccgtaccgtaccgtacgtaccgacggtacccgaaggtccctacccggcccccgtcgtcctaccggttccttaccccg

SEQ ID NO: 314331 - DNA, 580 bp, Homo sapiens
  misc_feature: GZ8MTXP02GLDUM.3.71.G05.1.454.CMB.2.raw
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
  modified_base (368)..(368): a, c, t, g, unknown or other
  misc_feature (368)..(368): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttcctttggctattttaaaaggtgtccggtgtgaagtgcaactggtggagtcgtgggggagcttgggtacagcctggcaggtccctgagactctcctgtgcagcctntggattcactttgatgattangccatgcacgtgggtcccgnaagctccgaggggacgggcctgggagtgggtctcgaggtacttacgtggaatagtgaataacngtcgctagtgcggtactcgtgtagaagggcctattcgacctatcctaccgagacgaaccaacgacccgaaacgtaaccctcccgtagtactcgtagactaaacgtagaactagtactgacgtaccgtgacggacaccggtcttagtacttacgagtacgtaaacggtaaccgggtaaatacgttacggtacgttagttttacgaactttacg

SEQ ID NO: 314332 - DNA, 705 bp, Homo sapiens
  misc_feature: GZ8MTXP02JO3YY.3.71.G05.1.454.CMB.2.raw
  modified_base (422)..(422): a, c, t, g, unknown or other
  misc_feature (422)..(422): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacagtcgaccaagggagacagccctacgaagaagtcttaattagtgacgaaagcgtacggtaacccaggacaagaacgcccgaaggtaccgaccgggtcccctagttaaccttgtctaacgtacgtaagtaacggtaaaaacccacccggccctacggaacgggactacccgacgtaccgtattcctaccgtcgctccgagtccgaacgaaacgaaccncgtacgtcctttacctagacctatcccgagtcgggcctacggacgggacgaacgtagcgggaacggtcctagtaaacttacgtttaaacccgtaccggttaacccggtaccccggggaactacgggtaaccggtaacggttaaacggttaaaccgtgtttacggagttaacggttacgggtaccgggacggggtaaaccgtacggtaggtaaccgtccgtaaccgttacgaccgacgacccgaagtccctaccggtccccgtagtccaccgttcgttcccccg

SEQ ID NO: 314333 - DNA, 515 bp, Homo sapiens
  misc_feature: GZ8MTXP02F1U9D.3.71.G05.1.454.CMB.2.raw
  modified_base (349)..(349): a, c, t, g, unknown or other
  misc_feature (349)..(349): n is a, c, g, or t
  modified_base (385)..(385): a, c, t, g, unknown or other
  misc_feature (385)..(385): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgcatctatacggtaaaaacaccggccctacgagggactccccagaccgattctctgctcagctcaaggacncagcttcctgaccatcacgtgggctcgaggcgaagntgaggctgactattactgtaacctcccgggcagcagtcgtaaacngttgngatagtcggacggtaggaccaggtcgaccgtctacgtacgacgacccaaggcctcgaccccctggtacctactcttcccg

SEQ ID NO: 314334 - DNA, 557 bp, Homo sapiens
  misc_feature: GZ8MTXP02JNGJJ.3.71.G05.1.454.CMB.2.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (360)..(360): a, c, t, g, unknown or other
  misc_feature (360)..(360): n is a, c, g, or t
  modified_base (379)..(379): a, c, t, g, unknown or other
  misc_feature (379)..(379): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
  modified_base (458)..(458): a, c, t, g, unknown or other
  misc_feature (458)..(458): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttggacagacagtcagatcacatgaccaaggagacagccctanaagaagctattangcaagctaggtacagacaagagccgagacacggcccctgtacttgcatctagtaacgaaaaacaccggcctacgaggactaccgaacgacgaatctacgtgcctacagctacgaaggaaccncagtccttacctgacctancacgtcgggctacgaggacggaagatggaggtctagactaagttacgngtagccgtaccgggaanacgagtacgaaacngtaggtgtagtcggaggacggtaaccaacgtcgaccgtacgtacgaccgacgacccaggccgtacccgccccgtgtacctccgtcctacccgtcccccg

SEQ ID NO: 314335 - DNA, 517 bp, Homo sapiens
  misc_feature: GZ8MTXP02FKWWE.3.71.G05.1.454.CMB.2.raw
  modified_base (237)..(237): a, c, t, g, unknown or other
  misc_feature (237)..(237): n is a, c, g, or t
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (399)..(399): a, c, t, g, unknown or other
  misc_feature (399)..(399): n is a, c, g, or t
  modified_base (480)..(480): a, c, t, g, unknown or other
  misc_feature (480)..(480): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctattangcaagctggtaccagcagaagccaggacaggcccctgtactgcatctataggtaaaaacaccggccctnagggatcccagaccgattcncctgctccagctacaggaacacagtcttcctgacatcacgtgggctnaggcgaaagangagctgactattacngtaaacgtccccgggacaggcaagtcgtaacagttgtagatagttcggacggtagggacgaaggtcgaccgtctacgtacncgacccaaggtcctacgccccctgtccacgtctcccg

SEQ ID NO: 314336 - DNA, 638 bp, Homo sapiens
  misc_feature: GZ8MTXP02JTIHR.3.71.G05.1.454.CMB.2.raw
  modified_base (239)..(239): a, c, t, g, unknown or other
  misc_feature (239)..(239): n is a, c, g, or t
  modified_base (338)..(338): a, c, t, g, unknown or other
  misc_feature (338)..(338): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacgagaagctattangacaagctaggaccagacagaagccaggacacggtcccctgtacttgtcatactataacggtaaaacaccgcctacgaggactaccgagaccgtattcnccgtcgcctccgatcacgaaggaaccacacgtaccttccgttacgaccctaaacgtccgtaacgtcggggtacctaccggaagggaccggaaagagtacggaacggtcgttaacgtaacgtttaacttaaccgtacggttaaacccgttccccggggacttacggaccgtaaggtaccgttaaatgtttaggtataaagtcgttacgggacggtaacgggacggtaaggtacgacccgtacgttaccgaccacggtccgaacgccgttcccggccccgtcggtcctactccgttaccccg

SEQ ID NO: 314337 - DNA, 676 bp, Homo sapiens
  misc_feature: GZ8MTXP02FP6GU.3.71.G05.1.454.CMB.2.raw
  modified_base (352)..(352): a, c, t, g, unknown or other
  misc_feature (352)..(352): n is a, c, g, or t
  modified_base (659)..(659): a, c, t, g, unknown or other
  misc_feature (659)..(659): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggaccagcagacgccaggacacggcccctgtacttgcatctatacggtaaaaacaccggccctagacggactcccagaccgtattctcctgctccagctacaaggaacncgacgtcttaccttacgaacctactccgtaacgtcgggggaccttacggaaggggaccggaaaagtactaggggaacgggtaccttacgggtaaaaccttaacgtttaaaccgttaacgggttaaaccccggttcccccgggggacctaagggtaccgtaagggttacgggttaaaccttaggtttaggttacgaagttacggttacgggggaacgggtacggggaaacccgtaagggtaccgtaacccggttccgtacggtaccgaacgaccccgaaggtcccgtccggtaccccccgtggtaccnccgttaccgtttccccg

SEQ ID NO: 314338 - DNA, 603 bp, Homo sapiens
  misc_feature: GZ8MTXP02JRLJV.3.71.G05.1.454.CMB.2.raw
  modified_base (260)..(260): a, c, t, g, unknown or other
  misc_feature (260)..(260): n is a, c, g, or t
  modified_base (306)..(306): a, c, t, g, unknown or other
  misc_feature (306)..(306): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttccttttggctattttaaaaggtgtccggtgtgaagtgcaactggtggagtcgtgggggagcttggtacagcctggcaggtccctgagactctcctgtgcngcctctgattcacctttgatgattatgccatgcacgtgggtccganaagctccgaggggacgggcctggagtgggtctcgtaggtacttacgtggaatagtagaataacngtcggntagtgcgactcgagtgaacggccgtattcgaacctatcctaccaagacgaacaacgaccaaacgacctaccctagtactcgtagaaccaaagtacgaaacgtagtactagacgtacccgtaggaaacggtaccgaccggtaccttagttaacttacgtaggttaacggtaaaacggtaacccgggtaaaattagtacggttaagttacgttttacggtaactttacg

SEQ ID NO: 314339 - DNA, 669 bp, Homo sapiens
  misc_feature: GZ8MTXP02IEAX1.3.71.G05.1.454.CMB.2.raw
  modified_base (244)..(244): a, c, t, g, unknown or other
  misc_feature (244)..(244): n is a, c, g, or t
tcagagacgcactccacgaccggtgctcgatttagtgtcgtcgcaagagagagggggcagaagcagagttctggggtgtctccaccatggcctggaccccctctctggctcactctcctcactctttgcataggttctgttggttttcttctgagctgactcaggaccctgctgtgtctggtggccttgggacagacagtcaggatcacatgaccaaaggagacagcctacaagaagctattangcaagctggaccagcagaagccaaggacacggcccctgtactgtcatctaataacggaaaaccaccggcctagacgggactacccaagaccgtattccgtcccgtacggcctccgagtcctacgaacggaaccacacgtcctttaccttagacccattaccgaacgtcgggggacctacggagggacggaaagagtacggacggtcgtagtaacttaagttaccgttacggtaaacccggttccccggggaacaacgtaccggtaaggttacgggtaaaaccttgtttacggttagtaacgtttacggttaccggggacggggtaacgggaaccgtaaaggggtaccgtaacccgtaccgtacgtaccgacggaccccgtaaggcctacccgtcccccgtaggtccctacgttccgttacccccg

SEQ ID NO: 314340 - DNA, 599 bp, Homo sapiens
  misc_feature: GZ8MTXP02H0WU7.3.71.G05.1.454.CMB.2.raw
  modified_base (324)..(324): a, c, t, g, unknown or other
  misc_feature (324)..(324): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcaagagccaggacacggcccctgtactgcatctatagaaaaccaccggcctagaggactcccagaccgattcnctgcctcagtctacaacggacacacgtccttccttgaccattccgacgtcggggactcgacgggacggaagacgtggacgtcgtagtaccgttaattaccgttacggtaaacccgttcccgggaccacggtaccgaggttacggtaaactacgtttaggtagtaacgttaagttcggggacggtaacggggtaaccgaaggggtcaccggttacctacggtaccaacggacccaagggtcctacccgccccgttacggcctaccgttccttcccg

SEQ ID NO: 314341 - DNA, 776 bp, Homo sapiens
  misc_feature: GZ8MTXP02JOOGY.3.71.G05.1.454.CMB.2.raw
  modified_base (312)..(312): a, c, t, g, unknown or other
  misc_feature (312)..(312): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttccttttggctattttaaaaggtgtccggtgtgaagtgcaactggtggagtcgtgggggaggcttggtacagcctggcaggtccctgagactctcctgtgcagcctctggattcacctttgatgattatgccatgcacgtgggtccganaacgctaccgaggggacggcgtgggaggtgggtctcgtaggtattacgtaggaatagtagtataaacgagtcggtactagtcggacggtacttcgtggtacgggaaacggggcccgtaatttacccgaaccctacgttccgtaaccccgaaggaaaccgaacccgaaaaccggacccctaaaacggtaaaccccctttacccccgttaggttaaacctttacccgttaacggaaacctaaaaacgttacggaaaaccttacgggtttaacccgtagggaaaaccggtaccccggttaaaggggaaaccggggtaacccgtaaacccgggggttacccttttaaagggttaacgttttaaccggttaaggggtttaaacgggttaaaaccgggggttaaccccggggggtaaaaatttacgggtttacgggtttaaaacggtttaacggtttttttaaaccgggg

SEQ ID NO: 314342 - DNA, 612 bp, Homo sapiens
  misc_feature: GZ8MTXP02J0DCK.3.71.G05.1.454.CMB.2.raw
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttcctttggctattttaaaaggtgtccggtgtgaagtgcaactggtggagtcgtgggggaggcttggtacagcctggcaggtccctgagactctcctgtgcagcctctggattcacctttgatgattatgccatgcacgtggccgcaagctaccgagggaggcctggagtgggtctcgaggtattacgtaggaatagtgataacgagtcggctagtcgcggtactcgtggtaggaacggggtccgtattccgaccctatcccgtaccgaagacgaaccaaaccggaccctaaacgaaccttcccgtagtactacctagacaaagtacgaactagtacgtacgaacgtacccgtaggacggtaccgaccgggtcttagtaacttacggtacgttaaggtaaaaccgggttcccgggtaaaattaggtacgttaacggttacgtttttaacgg

SEQ ID NO: 314343 - DNA, 623 bp, Homo sapiens
  misc_feature: GZ8MTXP02H2NDT.3.71.G05.1.454.CMB.2.raw
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (272)..(272): a, c, t, g, unknown or other
  misc_feature (272)..(272): n is a, c, g, or t
  modified_base (532)..(532): a, c, t, g, unknown or other
  misc_feature (532)..(532): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctanaagagctattangacaagctaggtaaccagacaagacgcgaggacncgccctgtactgcatcgtaataacggaaaaaccaccggcctacgacgggtactacccacgtaccgattcctacgtcggcctcacgctacgaacggtaccacgtaacgttcccttaccgttacgaaccctacgttaccgaaccgggttcgggggaccctacgggaacggggaaccggtaaaagtagtacgggaacggtctaacggtacttaagttaccgtacgtaacccgtcccggggactaacgcgtaagtacgtaaacngtttagagtactggtcggaggaacggacgtaacgggactaccgtactcggaccacgaccaaggcctaccgccccgtgacctcgtcctcccg

SEQ ID NO: 314344 - DNA, 532 bp, Homo sapiens
  misc_feature: GZ8MTXP02F6ZDQ.3.71.G05.1.454.CMB.2.raw
  modified_base (236)..(236): a, c, t, g, unknown or other
  misc_feature (236)..(236): n is a, c, g, or t
  modified_base (350)..(350): a, c, t, g, unknown or other
  misc_feature (350)..(350): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (507)..(507): a, c, t, g, unknown or other
  misc_feature (507)..(507): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattangacaagctggaccagcagaagccaggacaggcccctgtacttgtcatctataggtaaaaacaccggcctcgagggactccccagaccgattcacctgcctccagctacaggacncagcttcctgaccatcacgtcgggctccgaggcgaaagngngagctagactattacgtagtaccgccgggacagcgtagtacgtaactagttagtagagttacgtcgggacggacggaccgaaggtccgaccgtacgtacgcgacgaccaaggtccnccgccccgtcgtccaccgtctaccg

SEQ ID NO: 314345 - DNA, 620 bp, Homo sapiens
  misc_feature: GZ8MTXP02G8CMW.3.71.G05.1.454.CMB.2.raw
  modified_base (459)..(459): a, c, t, g, unknown or other
  misc_feature (459)..(459): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtgccttgggacagacagtcaggatcacatgaccaaggagacagcctacaagaagtctattatgacaagctggtaccagcagagccaggacacggccctgtactgctatctataacggtaaaaccaccggccctagaggactcccgaagtaccgtattccgacctcggacctaccgagtcctacgaacgggtaaccacgtaccggtcctttacccgtacggaaccctacgttcccgtaacggtcggggtacctacggaacgggtacgaagtacgtgaacggtnagtactagttacgtcggtaaaccgtcccgggacagacgtaggtaacgtactagttacgagtaagttacggtcgggacggtaacggacgtaaggttccgaccgttccgtacgacgacgacccgtaaggcctacccgtccccgtggtacctacgtccgtcccg

SEQ ID NO: 314346 - DNA, 632 bp, Homo sapiens
  misc_feature: GZ8MTXP02JDOFQ.3.71.G05.1.454.CMB.2.raw
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttattttaaaaggtgtccggtgtgaagtgcaactggtggagtcgtgggggaggcttggtacagccgtggtcaggtccctgacgactctcctgtgcagcctntgtacttctacttgatgtattangcctatgcacgtcgggtccgacaacgctaccggaggggaacgggtccgtagggagttcggggtctacggtaggttactttacgtaggtaaataggtagaataacgngtcggactagngtaccgacttcgtagtacggacgggaccgtacttccgacctatcctaccgacgaacgaaccaaccgaccaaacggtaccctccctagtacctactacgaactaaagtacgaactacgtactagaacgtacgagacggacgtaccggtcttagtacttacgtacgtaacggtaaacggtaaccgggtaaatacgtacgtaacgttacgtttaacgactttaacg

SEQ ID NO: 314347 - DNA, 566 bp, Homo sapiens
  misc_feature: GZ8MTXP02FQ4JT.3.71.G05.1.454.CMB.2.raw
  modified_base (285)..(285): a, c, t, g, unknown or other
  misc_feature (285)..(285): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (417)..(417): a, c, t, g, unknown or other
  misc_feature (417)..(417): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggctatttaaaggtgtccggtgtgaagtgcaactggtggagtcgtgggggagcttggtacagcctggcaggtccctgagactctcctgtcgcagcctcgtggacttcacttgatgattangccatgcacgtgggtccgcaagctaccgaggggacggccgtagggagtcggtctcgtaggttacttacgtaggaaattagtanaataacngtcgnttagcgcggactgtgtagacgggcctatcactatccncaagacacaaacgcaaagacctcctagtatactgaacaaacgtcgaacgagtactagaacgtaccgtaggacggtacacggttcttagtacttacgtagtacgtaaacggaaccggtaatacgtacgtattacgtttacgaactttacg

SEQ ID NO: 314348 - DNA, 599 bp, Homo sapiens
  misc_feature: GZ8MTXP02I5PGM.3.71.G05.1.454.CMB.2.raw
  modified_base (351)..(351): a, c, t, g, unknown or other
  misc_feature (351)..(351): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctacagaagctattatgacaagctggtaccagcagagccaggacacggcccctgtacttgcatctataggtaaaacaccggcctgaggactacccagaccgattctcctcggctccagctacgagaacncagtccttcctgaccatcacgtggggctcgagggacggaagacgtaggacggtctagtacttaagtttaccgtacggttaacccgttccccggggccaacggtccgtaaggtacggtaaacctagttacggtacgtaagtacggttcggggacggtacggggtaaaccgtaaggggtcgtaaccgtccgtacggtaccgacgtacccgaaggtcctccgtaccccgtcggcctaccgtccgtttcccg

SEQ ID NO: 314349 - DNA, 595 bp, Homo sapiens
  misc_feature: GZ8MTXP02F5L6S.3.71.G05.1.454.CMB.2.raw
  modified_base (318)..(318): a, c, t, g, unknown or other
  misc_feature (318)..(318): n is a, c, g, or t
  modified_base (447)..(447): a, c, t, g, unknown or other
  misc_feature (447)..(447): n is a, c, g, or t
tcagagacgcactccacgaccggtgctcgatttagtgtcgtcgcaagagagagggggagctctgggagaggagccccagccctgagattcccaggttgtttccattcagtgatcagcactgaacacagaggactcaccatggagttgggactgagctggtattttcctttggcttattttaaaggtgtcggtgtgaagtgcaacgtggtggagtcgtgggggagtcttggtacagcctggcaggtccctgagactctcctgtgcagcctctggattcactttgatgattatcgcctatcgctacgtcggggtcccganaacgctaccgaggggacggtcctaggggagtcgggtctaccgtaggttacttacgttaggaataggtatacgtaacgagtcggtactagtcgacggtacttcgtggtaggaacgggcctattccgactntcaccgaagacgacaaaccgaccaaagtaaccccttcctaagtactctacgacaaagtcgaaactgtacagacgtacgtgaacgactacgtcttagtactacgtagaaggtaaacgaccggtaaatgtacgtaacgtttattttaacg

SEQ ID NO: 314350 - DNA, 704 bp, Homo sapiens
  misc_feature: GZ8MTXP02IQ5SL.3.71.G05.1.454.CMB.2.raw
  modified_base (268)..(268): a, c, t, g, unknown or other
  misc_feature (268)..(268): n is a, c, g, or t
  modified_base (287)..(287): a, c, t, g, unknown or other
  misc_feature (287)..(287): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
tcagagacgcactccacgaccggtgctcgatttagtgtcgtcgcaagagagagggggctgggagaggagcccccagccctgagattcccaggtgtttccattcagtgatcagcactgaacacagaggactcaccatggagttgggactgagctggattttccttttggcttaattttaaaaggtgtccggtgtgaagtgcaactggtggagtcgtgggggaggcttggtacagcctggcaggtccctgagactctcctgtgcagcctntgattcacttgatgattangccatgcacgtcgggtccgacaagcctacgaggggaacggccgtggaggtgggtatcgtaggttacttacgttaggaataggtagataaacgngtccgntaagtgccggtactcgttggtacgggaaacggtcccgtaattccgaacctatacctacccgaagaacgaaccgaaaccgacctaaaacggtaaccctcccctaagttactccgtacgaaaccgtaaaagtcgaaaacgtacgttacgtacgtaaacggacccgttagggaacggtacccgtaaccgggttcctttaaaggttaacccgtttacgtaacgggtttaaacggtaaaaacccggggtttaacccgggggtaaaaatttcggtttaaacggtttaaaccggtttagttttttacgggtaaaactttttaacg

SEQ ID NO: 314351 - DNA, 586 bp, Homo sapiens
  misc_feature: GZ8MTXP02FUS55.3.71.G05.1.454.CMB.2.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctnaagaagctattangcaagctggaccagcagaagccaggacacggcccctgtacttgcatctaatacggtaaaaacaccggccctacagggactcccaagaccgattctctgcctccagctacaaggaacacagtcttacctgaaccatcacgtggggctacgaaggacgaaagatggacggctagaactattaacgtacgtaaaccgtccccggggactaacgacgtaagtacggtaaactagttagtagtaacttaagttcgggacgggaaacgggtacccgtaaagggtaccgaaccgttaccgtacggtaccacgacccgaaggccctaccgcccccgtaggtaccactccgttccccg

SEQ ID NO: 314352 - DNA, 582 bp, Homo sapiens
  misc_feature: GZ8MTXP02GOAQX.3.71.G05.1.454.CMB.2.raw
  modified_base (235)..(235): a, c, t, g, unknown or other
  misc_feature (235)..(235): n is a, c, g, or t
  modified_base (310)..(310): a, c, t, g, unknown or other
  misc_feature (310)..(310): n is a, c, g, or t
  modified_base (336)..(336): a, c, t, g, unknown or other
  misc_feature (336)..(336): n is a, c, g, or t
  modified_base (365)..(365): a, c, t, g, unknown or other
  misc_feature (365)..(365): n is a, c, g, or t
tcagagacgcactccacgaccggtgctcgatttagtgtcgtcgcaagagagaggggcagaagcagagttctgggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctattangcaagctggtaccagcagaagccaggacaggcccctgtactgtcatcgtataggtaaaaaacaccgggcccctanagggactccccaaggaccctatttcnccgtggctaccaggtctcgaagggaaccncgagtcttacctagaacagtcacgtcgggtcgtcgacggacggaagagagacggacgtacgtactacttacgtacgtaaccgtacccggaccgacgacgagtacgtaacgtagttagtagtagtagtcggacgggacgggaacgaacggtacggtaccgtaccgtaccgtaccgacgaccgaacggcgtccgccccgtccgtcctaccgtccgtccg

SEQ ID NO: 314353 - DNA, 704 bp, Homo sapiens
  misc_feature: GZ8MTXP02GQMR9.3.71.G05.1.454.CMB.2.raw
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaggagacagcctcagaagctatatgacaagctggaccagcagagccaggacacggcccctgtactgctatctaatacggtaaaaccacccggccctacgaacgggaccttaccccgaagaccgtacttcgtacccgtggcctaccacgtctacgaacggacacacgtccttacctcgaacctactccgacggttggggacctacggaaacggggacggaaagtagtcgggtaacggccgttaacgtaacctttaagtttaacccggttacgtaaaccccgggttcccccggggacccaagggtaccctaaaggtcgggttaaaacctgtttacgggtagtaacgtttacgggttaccggggaacgggtaacggggtaacccgtaaagggtcccggtaaacccggtccgtaaaacgggtccgaaaccggacccgtaacgggtccctacccgggtccccccgtacggtccctacccgttaccgtttacccccgg

SEQ ID NO: 314354 - DNA, 617 bp, Homo sapiens
  misc_feature: GZ8MTXP02IMLGQ.3.71.G05.1.454.CMB.2.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (270)..(270): a, c, t, g, unknown or other
  misc_feature (270)..(270): n is a, c, g, or t
  modified_base (387)..(387): a, c, t, g, unknown or other
  misc_feature (387)..(387): n is a, c, g, or t
tcagagacgcactccacgaccggtgctcgatttagtgtcgtcgcaagagagagggggcagaagcagagttctggggtgtctccaccatggcctggacccctctctggctcactctcctcactcttgcataggttctgtgtttcttctgagctgactcaggaccctgctgtgtctgtgccttgggacagacagtcaggatcacatcgaccaagganacagcctnaagaagtctaattangacaagctaggaccagacagaacgccaggacncggcccctagtacttgctatctaagtaacggtaaaaccacccggtccctagacgggtacctaccccgaagtaccgtattccgtccgtcggtcctaccgagtcctaacgaacgaaccncacgtccttaccgtacgactactcgacgtgggcctacgacggaggaaagtgtacggaggtactaggacttacttacgtacgtaaacccgtcccgggacagtccgaaggttacggaactggtttagagtattcggtacgggacggggtaacgacggtaaggtcgtaacccgtaccgtacggacctacgacccgaagcccgtccgccccgtacgtcctaccgtcttaccccg

SEQ ID NO: 314355 - DNA, 671 bp, Homo sapiens
  misc_feature: GZ8MTXP02JQO6M.3.71.G05.1.454.CMB.2.raw
  modified_base (238)..(238): a, c, t, g, unknown or other
  misc_feature (238)..(238): n is a, c, g, or t
  modified_base (338)..(338): a, c, t, g, unknown or other
  misc_feature (338)..(338): n is a, c, g, or t
  modified_base (366)..(366): a, c, t, g, unknown or other
  misc_feature (366)..(366): n is a, c, g, or t
tcagagacgcactccacgaccggtgctcgatttagtgtcgtcgcaagagagagggggcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgccaaaggagacagcctcagaagctattangcaagctggtaccagcagaagccaaggacaggcccctgtacttgacatctaataaggtaaaaacaccggccctacgagggactcccaagacccgtattcnccgtaggcctaccagctacgaaggaacncgaagtccttacctgaaccctatccacgtggggacctacgagggacggaaagagtacggaggtacctaggtaacttaagtttaaaccgtacggttaaaacccgtcccccgggggacctaaggacccgtaaaggttaacgggtaaacctagtttagggtagaaccgtttaaagttccggggaacggggtaacggggaacctaaaacggggttcgaaaccccgttaccgtaacgtaccgaccggaaccccgaaaggtcccgttaacccggcccccccgtttggaccctaccgtaccgtttcccccgg

SEQ ID NO: 314356 - DNA, 585 bp, Homo sapiens
  misc_feature: GZ8MTXP02JGPZW.3.71.G05.1.454.CMB.2.raw
  modified_base (327)..(327): a, c, t, g, unknown or other
  misc_feature (327)..(327): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (565)..(565): a, c, t, g, unknown or other
  misc_feature (565)..(565): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttcctttggctattttaaaggtgtccggtgtgaagtgcaactggtggagtcgtgggggagcttggtacagcctggcaggtccctgagactctcctgtgcagcctctggattcacctttgatgattatgccatgcacgtcggggtccgcaagctccgaggggaacgggccngggacgtggggtctcgaggtactttacgtggaataggtgataacngtcggntagtcgcggtactntgtgaagggcctaatcgacattcnccaganacacgtaccaagacctccagtatcgtagaaccaaaatcgaaaccgagtcgtagacgtacccgtgaagggaccacgggttcccttaggttaacttacgtaggtacggtaaaacgtcccggggtaaaattagtcgttaaacgttntttttaacggacttttaccg

SEQ ID NO: 314357 - DNA, 647 bp, Homo sapiens
  misc_feature: GZ8MTXP02G9NOW.3.71.G05.1.454.CMB.2.raw
  modified_base (242)..(242): a, c, t, g, unknown or other
  misc_feature (242)..(242): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaggagacagcctacaagaagtcttattancgacaagcgtacggtaccagcaagaacgccgaggaccgacggcccctagtacttgtactatactaagtaacggtaaaaaccacccggtaccctacgacggtacctaccccgaagtaccgtattccaccgtcggacctaccgacgcctacgaaacggaaccacgtacgtccttcctacgaacctacgtacgacggtcggggactacgaggggacgaaagacgtaggacgtacgtagtaacttacgtttaacgtaccgttaaacccggtccccgggacacgtacgtaagttacggtaactaggttacgtagtagtacgtcgggacggtacggaccgtaggtccgaccgtacgacgtacacggtaccaacgtccgtacccgccccgtacgtacctaccgtcctacccg

SEQ ID NO: 314358 - DNA, 635 bp, Homo sapiens
  misc_feature: GZ8MTXP02GPHIR.3.71.G05.1.454.CMB.2.raw
  modified_base (267)..(267): a, c, t, g, unknown or other
  misc_feature (267)..(267): n is a, c, g, or t
tcagagacgcactccacgaccggtgctcgatttagtgtcgtcgcaagagagagggggagctctgggagaggagccccagccctgagattcccaggtgtttccattcattgatcagcactgaacacagaggactcaccatggagttgggactgagctggtattttcctttggctattttaaaggtgtccggtgtgaagtgcaacgtggtggagtcgtgggggaggtcgttggtacagcctggcaggtcctgacgactctcctgtcgcncgcctcgtggtacttctacctttgatgtattatcgccatgcacggtcgggtccgacacgccgtaccggaggggaacgggtccgtagggaggtggggtctccgtaggttatttacgtaggtaataggtagataacgagtcggtatagtggcgtacttcgtggtacgaagtcgggactattccacctatcctacgagacgaaccgaacgaccaacgtaccctcctaggtactaccgtagaactaaagtacggaactgtacgacgaacgtaccgtaggaccggtaccgaacggttccgttaacggtacttaccgtaaggttaacggtaaaacgggtaccgggtaaattcgttaacgtttaagttttaacgg

SEQ ID NO: 314359 - DNA, 680 bp, Homo sapiens
  misc_feature: GZ8MTXP02HM29M.3.71.G05.1.454.CMB.2.raw
  modified_base (306)..(306): a, c, t, g, unknown or other
  misc_feature (306)..(306): n is a, c, g, or t
  modified_base (404)..(404): a, c, t, g, unknown or other
  misc_feature (404)..(404): n is a, c, g, or t
  modified_base (510)..(510): a, c, t, g, unknown or other
  misc_feature (510)..(510): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttccttttggcttattttaaaaggtgtccggtgtgaagtgcaacgtggtggagtcgtgggggagcgttggtacagccgtggcacgggtccctggagtacctctccgtgtgcacgcctctggtattcctacctttgatgtattancgccatcgctacgtcgggtccgacaagcctaccggaaggggtacggccgtgggagtcgggtctacgtacggttattacgtaggaattagtagataacngtacgacttagtcgacgtactcgtaggacggaacggccgtatcccgacctactctaacccgaagacgaaccaaacggcccaaaagtacccttcccgattactaccngaaacctaaagtacgaaactacggtacgtagaaccgtaacgtacgggtaacggaaccctaccggttaccgtttaggttaactttaccggtaaaggttaaccggttaaaacggggtaacccggggtaaaaattcggtttaacggtacggtttttaaactttttaaccgggg

SEQ ID NO: 314360 - DNA, 662 bp, Homo sapiens
  misc_feature: GZ8MTXP02GV69S.3.71.G05.1.454.CMB.2.raw
  modified_base (228)..(228): a, c, t, g, unknown or other
  misc_feature (228)..(228): n is a, c, g, or t
  modified_base (399)..(399): a, c, t, g, unknown or other
  misc_feature (399)..(399): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaaggagacagcctanaagaagcttaattatgacaaagctaggtaacccagacaagaacgccgaggaacacggtcccctagtacttgtcatactaagtaacggaaaaaaccgacccggaccctacgaacgggactacccgaagaccgtacttctaccgtcggcctaccgacgtctaacgaacgaacncgaacgtcctttaccctagaacctactcaacgtcgggacctacgaaggacgaaagtagaggaacgctagaacttagttaacgtcgtaaccgtcccgggacagtaccgaagtaacgtaacagttagtagtaacgtacggtcgggacggtaaacgggaaccgtaaagggtaccgaacccgttaccgtaccggtaccgaccggaaccccgaaacggttccccgacccggtaccccccgtggtaccctaccgttaccctttcccccg

SEQ ID NO: 314361 - DNA, 645 bp, Homo sapiens
  misc_feature: GZ8MTXP02J1EPQ.3.71.G05.1.454.CMB.2.raw
  modified_base (238)..(238): a, c, t, g, unknown or other
  misc_feature (238)..(238): n is a, c, g, or t
tcagagacgcactccacgaccggtgctcgatttagtgtcgtcgcaagagagagggggcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgaccaaggagacagcctcagaagctattangacaagctggtaccagcaagaagccaggacacggcccctgtacttgtacatactaagtaacggtaaaaaccacccggccctagacggactacccagaccgtattcctccgtcgcctccagctacgaaggaaccacacgtccttccgttacgaaccctactccgaacgttcgggggcctacggacggggtacggaaagagtaggaaggtctagtaaccttaacgttacgtacggtaaacccggtcccgggacgaggtaccgtaggtacgtaaacctagttagtgtaagttacggtacgggacgggtaacggaaccggtaagggtccgtaaacccgttaccgtacgaccgaaccggtacccgaacggtcccgtcccggcccccgttacggcctaccgttcccgtacccg

SEQ ID NO: 314362 - DNA, 703 bp, Homo sapiens
  misc_feature: GZ8MTXP02FR8KC.3.71.G05.1.454.CMB.2.raw
  modified_base (233)..(233): a, c, t, g, unknown or other
  misc_feature (233)..(233): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttcctttggcttaattttaaaggtgtccggtgtgaagtgcaactggtggagtcgtgggggagcttggtacngcctggcaggtccctgagactctcctgtgcagcctcgtgacttcacctttgatgtaattatcgcctatcgcctacgttcggggtcccgacaacggtccgtacccggaagggggaacgggtcccgtaggggtacggtcggggtcctacggtaagggtttactttaacggttaggtaaattaggttagtaacgttaaactacgtccgggtacttaagtcggaccgggtacttcgtgggtacggaacggggtcctatttacccgactacgttcctacccgaagacgaacccaaaccggaacctaaacgtaaccccttccgtagttaactccgtaacgaactaaaagtcgaaacgtcgttaccgtagaaccgtaaccgtaggacggtacctaaccggttccgtttagtaacttacgtaggtaaccggttaaacggtaccgggtaaaatgttacgtaagtttagtttttaaaccg

SEQ ID NO: 314363 - DNA, 717 bp, Homo sapiens
  misc_feature: GZ8MTXP02FJUHI.3.71.G05.1.454.CMB.2.raw
  modified_base (291)..(291): a, c, t, g, unknown or other
  misc_feature (291)..(291): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttcctttggctattttaaaaggtgtccggtgtgaagtgcaactggtggagtcgtgggggaggcttggtacagcctggcaggtccctgagactctcctgtgcagcctctggacttcacctttgatgattangcctatgctacgtcgggtcccggacgaacgccgtacccgaaggggaacgggtccgtagggaggttcggggtctaccgtaggttattaacgttaggtaaataggtagactaaactacgttacggacttaagtcggacgggtactacgtggtacggaacggggacccgtaagttccgaaaccctacgtcccgtacccgaaggaaaccggaaaccaaacccggaacccaaaacggtaacccttccccgtagtaaaccttacctacggaaacctaaaactacggtaaaacacggttacgaagaacgtaaccgtacgggacgaaaccgtaaccggttccgtttacgttaacgttacgtaggtaacggttaaaaccggttacccgggggtaaaattacggtttaaggttaaccggtttaagtttttaacggg

SEQ ID NO: 314364 - DNA, 628 bp, Homo sapiens
  misc_feature: GZ8MTXP02FTO1J.3.71.G05.1.454.CMB.2.raw
  modified_base (264)..(264): a, c, t, g, unknown or other
  misc_feature (264)..(264): n is a, c, g, or t
  modified_base (286)..(286): a, c, t, g, unknown or other
  misc_feature (286)..(286): n is a, c, g, or t
  modified_base (309)..(309): a, c, t, g, unknown or other
  misc_feature (309)..(309): n is a, c, g, or t
  modified_base (395)..(395): a, c, t, g, unknown or other
  misc_feature (395)..(395): n is a, c, g, or t
  modified_base (529)..(529): a, c, t, g, unknown or other
  misc_feature (529)..(529): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggctaattttaaaaggtgtccggtgtgaagtgcaactggtggagtcgtgggggaggcttggtacagcctggcaggtcctgagactctctgtgcagcctntggattcactttgatgtattangccatcgcacgtcgggtcccganaacgccgtaccgaggggaacgggccgtaggggtacggtgggtctacgtaggttacttacgttaggaaataggtagaaacttaacgngtcggactagtgtccggtaacttcgtgggtacgggacggggtacctattccaaccgtattccgaccaagaacgacgaaacgcccgaaaagtaccctccgtaagtactaccgtagaacaaagtagaaactcgtangaacgacgtaggaacggaccacggtccttagtaacttacgtagtacggttaaaacggccggtaaatacgttacgtacgtttagtttacggaactttacg

SEQ ID NO: 314365 - DNA, 627 bp, Homo sapiens
  misc_feature: GZ8MTXP02HI6HF.3.71.G05.1.454.CMB.2.raw
  modified_base (377)..(377): a, c, t, g, unknown or other
  misc_feature (377)..(377): n is a, c, g, or t
  modified_base (439)..(439): a, c, t, g, unknown or other
  misc_feature (439)..(439): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttccttttggctattttaaaaggtgtccggtgtgaagtgcaacgtggtggagtcgtgggggaggcttggtacagcctggcagggtccctgagacctctcctgtgcagcctctggtactcacctttgatgtatatgccatgctacgtgggtccgcaagcctaccgaggggaggccgtgggagtgggtctccgtaggttattacgtggtaataggtnacgtaacaagtcggactatcggacgggtactcgtggtacggacgggtcgtacttccgacctntacctccgaagacgaaccaacgaccctaaagacccttcctgtactccgtagactaatacgaactagtcgacgtaacgtacgtacggacggaacctacggggtaccctttagtacgtttaacgtacggttaacggaaaacgggttacccggggtaaaatacgtttacggtaacgtttagtttttaacgg

SEQ ID NO: 314366 - DNA, 566 bp, Homo sapiens
  misc_feature: GZ8MTXP02JDYUX.3.71.G05.1.454.CMB.2.raw
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtatttcctttggctatttaaaaggtgtccggtgtgaagtgcaactggtggagtcgtgggggaggcttggtacagcctggcaggtccctgagactctcctgtgcagcctcnggattcacctttgatgacttatgccatgcacgtgggtccgnagctccgagggaggcctggagtgggtctcgaggttatacgtggaatagtgataacgagtcggctaagtgcggtactcgtgtaggaacggggtccattccgacctagtcctacagacacaacgtccaaagtacctcccgtagtactcctgaaccaaatcgaactagtcctagacgacctggacgtaccacggtcttagtactcgttaggtaacgtaaaacggtccgggtaaaatgtacggtaacgttagttttaacgg

SEQ ID NO: 314367 - DNA, 649 bp, Homo sapiens
  misc_feature: GZ8MTXP02HO45P.3.71.G05.1.454.CMB.2.raw
tcagagacgcactccacgaccggtgctcgatttagtgtcgtcgcaagagagagggggctgggagaggagcccccagccctgagattcccaggtgtttccattcagtgatcagcactgaacacagaggactcaccatggagttgggactgagctggtattttcctttggctattttaaaaggtgtccggtgtgaagtgcaacgtggtggagtcgtgggggagtcttggtacagccgtggcaggtccctgacgactctcctgtgcagccctcgtggattcctacctttgattgtattatcgccagtcgctacggttcgggtccgactaacgccgtaccggaggggaacgggccgtagggtaggtcgggttctacggtacggttacgttacgttagggtaattaggtacgaacttaacgacgtcgggtactaagtacgtcgggtaacttcgtgggtagggtaacgggacctaattccaacctagttcacccgaagaacgaaccaaacgcctaaaacgaaccttcccgtattataccagaactaaagtagaccatcgagaacgacaggacgtacacggtacttagtaccttagtcggtaaagtaacggtaaccggtaaattacgttacgtagttagtttacggaacttttacg

SEQ ID NO: 314368 - DNA, 917 bp, Homo sapiens
  misc_feature: GZ8MTXP02JFSBC.3.71.G05.1.454.CMB.2.raw
  modified_base (218)..(218): a, c, t, g, unknown or other
  misc_feature (218)..(218): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaagganacagcctacgaagaagtcttaattagtgacaaggtccgttacggaacccagacgaaagaacgacccgaaggaccaccggtcccctagttacgttcgactaacgttacgtaacgtaaaacggtaaaaaccgaccccggtaccccgtaaggaacgggtacctaccccggaacgtaccgtactttccgtacccgttacggacccttaccgaacgtacccgtaacggaaaacgggtaaacctccgtaacgttaccccgtttacccgtaaccgtaacccctacgttacccgggtaaccggggttcgggggaacccttacggggaaaacccgggggttaaaccggtaaagggttaacggttcccgggggtaaacggttacccggttaaagggttaaaaccctttaaaccgggttttaaacggtaacccccgggttaaaccccgggttacccccgggggaacctaaacggggttacccggttaaaagggttaacccggttaaaacgttggttttacggtaaaggttaccgttacggggtaaccgggggaacgggtaaaccgggtaaccggtaaacgggttcccggtaaacccgttaccggttaaccggtacccgaaacccgggttaccccggaacgggttcccccgttaccccggtaaccccccggggtttacgttaacccttacccggtttacccgttacccccg

SEQ ID NO: 314369 - DNA, 742 bp, Homo sapiens
  misc_feature: GZ8MTXP02H22QZ.3.71.G05.1.454.CMB.2.raw
  modified_base (242)..(242): a, c, t, g, unknown or other
  misc_feature (242)..(242): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctggtggccttgggacagacagtcaggatcacatgaccaaggagacagcctacaagaagcttaattancgacaagcgtacggtaccagacaagaacgccgaaggacacggcccctagtacttgtctatactaagtaacggtaaaaaccaccggaccctacgaacgggtactacccgaacgaccgtattctccgtcggacctaccgacgtcctacgaaacgaaccacgacgtccttaccgtacgaaccactaccgaacgtcggggacctacggaacgggtacggaaagtacgtacgggacggtacgtacgtaacttaacgttaccgttaacggttaacccggttaccccggggactaacggtaccgtaacgggttaacggtaaacctaggttttaggtacgtaaacgtttacgggttaccggggaacggggtaacgggtaaaccggtaaggggtacccggtaaaccccggttacccgttaaccggaccgtaaaccggtaccccggtaaacgggtcccgtaaccccggtccccccggttacggtacccctaccgtttcccgttcccccgg

SEQ ID NO: 314370 - DNA, 728 bp, Homo sapiens
  misc_feature: GZ8MTXP02JTIY2.3.71.G05.1.454.CMB.2.raw
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttcctttggcttaagttttaaaaggtgtccggtgtgaagtgcaactggtggagtcgtgggggaggtcttggtacagcctggcaggtcctgacgctctcctgtgcngcctnggnttcacctttgatgtattagtcgcctatcgctaccggtcggggtccgacaacgtccgtccggaaaggggaacgggccggtaggggaggtggggtcctaccgtagggttaactttacggttaggtaagtaacggtagtactaaaccgtagttccggtacgttaagtcggacggtacctttcgtaggtacggaacggggtcctactttaaccgactaacgtcccgtaacgaagaccgaacctaaaaccggccaaaacggtacccttacccgtagttaaccttacaacggtaacaaaagttcgaaactagttacgtacgaacggtacccgttagggaaacctacccggggtacgttacccgtttagttaaactttacggtaagggttaaaccggttaaaaccgggtaaccggggtaaaacttgttaacgggtttaaaacgtttgtttttaaacccgg

SEQ ID NO: 314371 - DNA, 683 bp, Homo sapiens
  misc_feature: GZ8MTXP02I77HM.3.71.G05.1.454.CMB.2.raw
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
tcagagacgcactccacgaccggtgctcgatttagtgtcgtcgcaagagagagggggcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgaccaaggagacagcctcagaagctattangacaagctggtaccagnagaacgcaggacacggcccctagtacttgtcatctagtacggtaaaaaccaccggtccctacgaggactaccccgagtacccgattcctaccgtcgacctccagtctacgaacggtacacgtacgtccttccgtacgaacctacgtcctaaaccggtcggggacctaccggaagggaccggtaaagtagtcggaaaggtcccgttacgtaaaccgttaacttacccggtacgttaaacccggtcccccggggacaaacgggtccgaaagggttacgtaaaccgtagtttagtacgtaaagttacgttcggggaacgggtaacggggaccgtaaggggtacccgtaaacccggtaccgtaaccgtcgaacccgaccggtaacggcccgttaccgacccccggttgtacccgtacgttacccgttccccg

SEQ ID NO: 314372 - DNA, 684 bp, Homo sapiens
  misc_feature: GZ8MTXP02JWDMK.3.71.G05.1.454.CMB.2.raw
  modified_base (291)..(291): a, c, t, g, unknown or other
  misc_feature (291)..(291): n is a, c, g, or t
  modified_base (403)..(403): a, c, t, g, unknown or other
  misc_feature (403)..(403): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttattttaaaaggtgtccggtgtgaagtgcaactggtggagtcgtgggggagcttggtacagccgtggcaggtccctgacgactctcctgtgcagcctctggacttcacctttgatgtattancgcctatcgctacgtcgggtcccggacaacggtccgtaccggaaggggaacgggccgtagggtaggtcgggtctacgtaggttacttacgtaggtaatagtagaattaacgngtcggctacgtggacgtacttcgtaggtacgggtaacggggcccgtattaccaccctacttccctaccgaagaacgaaccaaccgtacccaaacgtaccctcccgttagtacctacgtagaaacctaaagtacgaactagtactaggaacgtaccgtaggaaccggacgtacggtacccttttagtaacgtttacgttacgggttaaacgtaaaccggggttaacccggggtaaaattacggttacgtttaacgtttagtttttaacggtacttttaaccg

SEQ ID NO: 314373 - DNA, 583 bp, Homo sapiens
  misc_feature: GZ8MTXP02JTXT7.3.71.G05.1.454.CMB.2.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (257)..(257): a, c, t, g, unknown or other
  misc_feature (257)..(257): n is a, c, g, or t
  modified_base (326)..(326): a, c, t, g, unknown or other
  misc_feature (326)..(326): n is a, c, g, or t
tcagagacgcactccacgaccggtgctcgatttagtgtcgtcgcaagagagagggggcagaagcagagttctggggtgtctccaccatggcctggaccccctctctggctcactctcctcactctttgcataggttctgtggtttcttctgagctgactcaggaccctgctgtgtctgtggccttgggacagacagtcaggatcacatgccaaggnacagcctnagaagctattatgcaagctagtaccagcagaanccaggacaggcccctgtacttgcatctataggtaaaaacaccggcctacagggactcccagaccattcnctgctcagctcgagacacagtctcctgaccatcacgtgggctcgaggacggaagatgaggctgtactagttactacgtaaaccgtcccgggacagcgtaaggtagtaaacctagtttggtacgaatttacggttacggggaccggtaacggggtaaaccaaagggggttcgaaccccggttactaaccggtacgaacggccccgaaaaggtccctaccggacccccttcgggtacctacccgttcgtttacccccgg

SEQ ID NO: 314374 - DNA, 626 bp, Homo sapiens
  misc_feature: GZ8MTXP02F33QJ.3.71.G05.1.454.CMB.2.raw
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (330)..(330): a, c, t, g, unknown or other
  misc_feature (330)..(330): n is a, c, g, or t
tcagagacgcactccacgaccggtgctcgatttagtgtcgtcgcaagagagaggggggagctctgggagaggagccccagccctgagattcccaggtgtttccattcagtgatcagcactgaacacagaggactcaccatggagttgggactgagctggtattttcctttggcttattttaaaggtgtccggtgtgaagtgcaatggtggagtcgtgggggaggcttggtacagcctggcaggtccctgngactctcctgtgcagcctctggattctacctttgatgattangcctangcacgtggtccgcaagctcgagggacggtccngggagtcgggtctaccgtaggtacttagttaggtaagtagttagagtaacagtcggtcgtatggacgcgttctggtaggaacgggcgtacgttcaacctctactccgaagaacgaacgaaacccggacctaaacgaaccctccgtacttactacgtagaaccgtaaatacgtaaacgagtactaggacgtaacgtacgacggtaccgaaccggtaccttacgttagttacgttagtaacggttaaaacggtacccgggggtaaaattacgtaaggttaccgttagtttttaaaccg

SEQ ID NO: 314375 - DNA, 591 bp, Homo sapiens
  misc_feature: GZ8MTXP02I7VRT.3.71.G05.1.454.CMB.2.raw
  modified_base (385)..(385): a, c, t, g, unknown or other
  misc_feature (385)..(385): n is a, c, g, or t
  modified_base (433)..(433): a, c, t, g, unknown or other
  misc_feature (433)..(433): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttccttttggctattttaaaaggtgtccggtgtgaagtgcaactggtggagtcgtgggggagcttggtacagcctggcaggtccctgagactctcctgtgcagcctctggattcactttgatgattatcgcctatgcacgtcgggtccgacaagccgtcggaaggggaacgggcctgggaggtgggtcctacgtaggttactttacgtaggaactagtgaattaacngtcgactagtcggcgtactcgtgtaggacgggcctacttcacctatcnccagacgacaacgcaaacgtacctcctagtactcgtacgaacaaagttacgaacgtacgtactagaacgtacgtaggacgacgtacgtccttagtacttacgtacgtaagtaacggtaacgggtaaactgtacgtacgttacgtttacggactttacg

SEQ ID NO: 314376 - DNA, 540 bp, Homo sapiens
  misc_feature: GZ8MTXP02JUDMP.3.71.G05.1.454.CMB.2.raw
  modified_base (184)..(184): a, c, t, g, unknown or other
  misc_feature (184)..(184): n is a, c, g, or t
  modified_base (268)..(268): a, c, t, g, unknown or other
  misc_feature (268)..(268): n is a, c, g, or t
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
  modified_base (367)..(367): a, c, t, g, unknown or other
  misc_feature (367)..(367): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttcctttggctattttaaaaggngtccggtgtgaagtgacaactgggtggagtcgtgggggagcttggtacagcctggcaggtcctgagactctcctgtgcagcctnggattcactttgatgattangccatgcacgtggtccgnaagcctacgaggggacggctggagtcgggtctccgagtattacgtggaatagtgataaacngttccggatatggacgtactcgtggtagacgggcattcaccgatcncagacgacaacgctaaacgactccagtactcagacaatcgaaacngtcagacacgagacgacgacgtacttacgtacgtcgtagtaacggtaacggtacggtaattagtacgttacgttagtttacg

SEQ ID NO: 314377 - DNA, 722 bp, Homo sapiens
  misc_feature: GZ8MTXP02HXN7L.3.71.G05.1.454.CMB.2.raw
  modified_base (250)..(250): a, c, t, g, unknown or other
  misc_feature (250)..(250): n is a, c, g, or t
  modified_base (326)..(326): a, c, t, g, unknown or other
  misc_feature (326)..(326): n is a, c, g, or t
  modified_base (411)..(411): a, c, t, g, unknown or other
  misc_feature (411)..(411): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgttggttttcttctgagctgactcaggaccctgctgtgtctgtggccgttgggacagacagtcaggatcacatcgaccaaggacgaacacgccctagaagaagtactaattangacaagtcgttaggaccaggacaaaggacgaccgaaggaccgaccgggtccctggtggtggtagaattaaataaanaaacgacgaggtaggaaacggcgaccctacggagggtaacctcccggtagaacgtcgtactttaccgtcgtcggtccttaaccgnggtaccgtaacgggaaccggtaaccgaaaagtccgtaacgtaccgttacgaacctacgtacgtaggtacggacgtaccggacggacgacgggaggacgacggaccgtagtaacctttagttacgtttagtactaacgttaccgaagaaccgaaacggaaactaaaaccggttaaagtaaaactttaaccttttaacgtttaatttttaaccggttacgtttaccgttacggttacgttacggttaacggggaacccgttcggaaccgttacccggtacgtacggttacccgaccgtaaccccggaaacccg

SEQ ID NO: 314378 - DNA, 731 bp, Homo sapiens
  misc_feature: GZ8MTXP02G0NUB.3.71.G05.1.454.CMB.2.raw
  modified_base (232)..(232): a, c, t, g, unknown or other
  misc_feature (232)..(232): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttaattttaaaaggtgttccggtgtgaagttgacaactggtggagtcgtgggggagcttggacngcgtggcacggtccctgagtactctcctgtcgcacgtcctcgtgtattcctacctttgatgtattatcgaccatcgctacggtcgggtccggacaacgcccgtacggtaggggacgggtccgtgggtacggtgggtacctacggtagttaacgtttacgtaggtaagttaggtataacgtaactaggtccggtaattacgtgtaccggtacttgtagggtacggaaccgggtcgtaacttaccgaactacgtcctaccgaaagtaaccgaacctaacgaccgtaaaacgtaaccctccgttagtaactcctacggtaaacaaaccgttagaaacgtcgtacgtacggaaccgtaacccgtagggtaaccggtaccgtacggttacccttaggttaaaccttaacgggtacgttaaaccgggttaaaacggggtaaccccggttaaagttacggttaaccggtaacggttttacgttttaaacggtaacctttttaccgg

SEQ ID NO: 314379 - DNA, 630 bp, Homo sapiens
  misc_feature: GZ8MTXP02F9WP8.3.71.G05.1.454.CMB.2.raw
  modified_base (312)..(312): a, c, t, g, unknown or other
  misc_feature (312)..(312): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttcctttggcttaattttaaaaggtgtccggtgtgaagtgcaactggtggagtcgtgggggagcttggtacagcctggcaggtccctgagactctcctgtgcagcctcgtggacttcactttgatgtattatcgccatgcacgtcgggtccganaacgcgtaccggaggggaacggcctaggggtacggtgggtactacgtaggttatttacgtagggaaattaggtcgaaataactaggtcggacttaagtcgacggtactacgtggtagaaacggggcctaattacaacctataccaccgaagacgaaacaaccgacaaacgacctccctagtactacgtagactaaaatcgaaacacggttacagaacgtaccgaggacggacgacggttaccttaggttaattaccgttagtaacgtaaaacggtaaccgggtaaattagtacgtagtttagtttacggtaactttac

SEQ ID NO: 314380 - DNA, 649 bp, Homo sapiens
  misc_feature: GZ8MTXP02ICYSR.3.71.G05.1.454.CMB.2.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
tcagagacgcactccacgaccggtgctcgatttagtgtcgtcgcaagagagagggggcagaagcagagttctggggtgtctccaccatggcctggaccccctctctggctcactctcctcactctttgcataggttctgttggtttcttctgagctgactcaggaccctgctgtgtctggtggccttgggacagacagtcaggatcacatgaccaaggagacagcctnaagaagcttatancgacaagcgtacggtaccagcaagagccgaaggacacggccctagtactgctatctaagtaacggaaaaacacccggcctagaaggacctacccgagtaccgtattccgtacgcgcctacgacgtctacgaaacgacaccgactccttccgtacgaacctacgtccaacggtcgggggacctacggaacgggtacggaagtacgtaggaacggtcctaagtacgtttaactacgtacgtaaccgcccgggtacacgacgtagtacggtaactagttgtaagtacttacgggtacggggacgggtaaccgggacgtaaacgggtccgtaaaccggttacaacggttccaaccggtaccccgaaggtcccgtaccggacccccgtcggtacccaccgtttccgacccccg

SEQ ID NO: 314381 - DNA, 830 bp, Homo sapiens
  misc_feature: GZ8MTXP02HGG3M.3.71.G05.1.454.CMB.2.raw
  modified_base (217)..(217): a, c, t, g, unknown or other
  misc_feature (217)..(217): n is a, c, g, or t
  modified_base (242)..(242): a, c, t, g, unknown or other
  misc_feature (242)..(242): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctacaagaagtcttaattangacaagcgtacggtacccagacaaggaacgccgaaggaccacgggtcccctagtaccttgactacttctaaacgtaacggtaaaaaaccacccggtccctacgaaacggggtacctaccccgaaggtaaccccggtactttcctccccggtacggtacccttacccgacgtaccgttaaccgaaacggggtaaacctaccgtaaaccggttcccgttttacccgttaaccggaaacccctaagttacccggtaaacggtttcgggggacccttaacggaacgggggtaaccggaaaggtaccgttaggaacgggttccgttaaagtaaccgtttaaactttaccggtaaacggttaaccccggtaccccgggggactaacggtacggtaaacggttacgtaaacgttaggtttaggtacggttaacgttacgggtttacgggggaccgggttaaacgggtaaaaccggtaaggggtacccgttaaccccggaccgtttaaaccgaccgaaccggtaccccggtaaacgggtccccgtcccgggtaaccccccgttggtaccctaccggtttccccgtttaacccccgg

SEQ ID NO: 314382 - DNA, 784 bp, Homo sapiens
  misc_feature: GZ8MTXP02JE6YL.3.71.G05.1.454.CMB.2.raw
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttccttttggcttaattttaaaggtgtccggtgtgaagtgcaacgtggtggagtcgtgggggagtcgttggacagcctggcaggtccctgagactctctgtcgcngcctcngtattcacttgatgattancgaccatgacacggtcgggtccgacaacggccgtaccggaagggggaacggtccgtaggggtacggtggggtcaccgtaaggttacttaacggttaggtaaattaggtacgtaagttaacctacgttccgggtaacttacgtcggggtaccggtacccttggttacgggtaacgggaaaccgggggtccccgttaatttaccccgaacctacgtttccccgtaaccggaaagtaaacccggaacccgaaaacccggacccttaaaaacgggtaaacccccctttccccgtaggtttaacccgacttaaccggaaactaaacgggttaacaaaaccgtggtaccgtaacggaaaccgaaccgtagggaacccgggtaaacgtacccgggttactttaacgggtaacttacggttagggtaaaccgggttaaaaccgggttacccggggttaaaaattcgtttacgggtttaaccgtttagtttttaaaccggg

SEQ ID NO: 314383 - DNA, 894 bp, Homo sapiens
  misc_feature: GZ8MTXP02FNH6P.3.71.G05.1.454.CMB.2.raw
  modified_base (217)..(217): a, c, t, g, unknown or other
  misc_feature (217)..(217): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaagganacagcctcaagaagcttattatgacaagctaggtaccagacagaacgccgaggacacggcccctagtacttgtcatactaataacggtaaaaaccacccggcccctacgaacggactacccaacgaccgtattcctcccgtcggcctaccgacgacctacgaaacgggaaccacgaacgtcctttacccgttacgaaccctatacccgaacgggttcgggggacccttacgggaaacgggggtaccgggaaaacgtaacggtacggggaacgggtaccgttacgggttaaaaccctttaaacgttttaaacccggttaaccgggttaaaacccccgggttacccccccggggggaaccgtaaaccggggtaacccggttaaaggggtttaaaccgggggtttaaaacctttaacggtttttagggttaaacggttaaacggtttaaaccgggggttttacccggggggaaaccggggggttaaaaccgggggtaaaacccccgggttaaaagggggttaaccccggtaaacccccggggtttaccccgtaaacccgggttacccgaaacccgggtaacccccggtaaaaccgggggtcccccgttacccccgggtacccccccccggttacggggtttaccccctaaaccccggtttccccgttttaacccccccgg

SEQ ID NO: 314384 - DNA, 679 bp, Homo sapiens
  misc_feature: GZ8MTXP02JTPDW.3.71.G05.1.454.CMB.2.raw
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (377)..(377): a, c, t, g, unknown or other
  misc_feature (377)..(377): n is a, c, g, or t
tcagagacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggtattttccttttggcttaattttaaaaggtgtccggtgtgaagtgcaactggtggagtcgtgggggagcttggtacagcctggcaggtccctgagactctcctgtgcagcctctggacttcacctttgatgattangccatgcacgtcgggtccganagctccgaggggaacgggccgtggagtcgggtctcgtaggtacttacgtagaatagtgaataacgngtcggattagtagcggtactcgtaggtaggaacggggtccgtaagttaccaccgtactccgtacccgaaggaacgaaccgaaaccgaaccaaaacgaacccttaccccgtaggtaacctcttacggaacctaaaagttacggaaaaccctagttaccgaacggtaaccgaaccgtagggaacggtaccggtaacccggtccgttaaggttaacgtttaaccgtaggttaacggttaaaacgggtaacccgggggttaaataccggttagttaaccgtttaggttttaaccggtaactttacg

SEQ ID NO: 314385 - DNA, 765 bp, Homo sapiens
  misc_feature: GZ8MTXP02GP7MQ.3.71.G05.1.454.CMB.2.raw
  modified_base (254)..(254): a, c, t, g, unknown or other
  misc_feature (254)..(254): n is a, c, g, or t
  modified_base (489)..(489): a, c, t, g, unknown or other
  misc_feature (489)..(489): n is a, c, g, or t
tcagagacgcactccacgaccggtgctcgatttagtgtcgtcgcaagagagagggggcagaagcagagttctggggtgtctccaccatggcctggacccctctctggctcactctcctcactctttgcataggttctgttggtttcttctgagctgactcaggaccctgctgtgtctggtggccgttgggacagacagtcaggatcacatgaccgaaggacgacacgcctacgaaggaacgtcttaatttacgngacaacgtcgtacggtaccagacaacggaaacgccgtaaggaccgtacggtccccttagttactttcgacctacgtacttaacggtaaaccggtaaaaacccgtacccggtccccttacggaacggtaccctaccccggacgtaacccgtactttccgacccgtaccggtctacccaaggtcctacggaaacgaacccgtacgtacccgttaccgttaccctacctacccgtacnccgtaaccgggttcggggtaccgtaacggaacggggtacgggtaaagtacggtagggaccgtacggtacgttaaacttaccggttaacggttacccggtaaaccggtcccgggtaaccgtacggtacgtaacggtacgttaacgttagttagtacgttaacgttacgggtacggggaaccggtacgggaaccggtacggtaccggtaccgtaccgttaccgaccgtaccgtaccgaaccgaccgtccggtcccctaggcccttcgtccgttccccg

SEQ ID NO: 314386 - DNA, 693 bp, Homo sapiens
  misc_feature: GZ8MTXP02JJ7SW.3.71.G05.1.454.CMB.2.raw
  modified_base (273)..(273): a, c, t, g, unknown or other
  misc_feature (273)..(273): n is a, c, g, or t
  modified_base (316)..(316): a, c, t, g, unknown or other
  misc_feature (316)..(316): n is a, c, g, or t
tcagagacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggtattttccttttggctattttaaaaggtgtccggtgtgaagtgcaactggtggagtcgtgggggaggcgttggtacagcctggcaggtccctgagactctcctgtcgcagcctcngattcacctttgatgtattatgcctatgctacgtgggtcccgnaacgcctaccgaggggacggccgtggaggtgggtcctcgtaaggtacttacgttaggaataggtagtataacgagtcggactagtcgacggtacttacggtgttacggaacggggtccctaactttcccgaacctacttactacccgaaagggtaccgtaacaaaacccggcccaaaaggtaacccccgttaccccttagtaacctaccgttacgaacctaaaagtccgaaaagtccggttacgtaacgaaccgttaccgtaagggacgggaacccgtaaacgggtccctttaggttaaacctttcgaaggttaaacggttaaaaccgggttccggggtaaaattcgtaacggtttaacggttagtttttaaccggg

SEQ ID NO: 314387 - DNA, 420 bp, Homo sapiens
  misc_feature: GZ8MTXP01C2A8P.11.20.B09.1.454.CMB.2.raw
  modified_base (416)..(420): a, c, t, g, unknown or other
  misc_feature (416)..(420): n is a, c, g, or t
tcagcgagagataccacgaccggtgctcgatttagtgtagtgtgaagggtacgtgccaagcatcctcgtgcgaccgcgagagcccggggagcggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgctccttagcctccaccaaagggcccatcggtctccccctggcaccctcctccaagagcacctctgggggcacagcggcccccctgggctgcctggtcaaggctacttccgtatctctcgctgagcgggctggcaaggcgcatagnnnnn

SEQ ID NO: 314388 - DNA, 430 bp, Homo sapiens
  misc_feature: GZ8MTXP01B7KDI.11.20.B09.1.454.CMB.2.raw
  modified_base (425)..(430): a, c, t, g, unknown or other
  misc_feature (425)..(430): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggactctgggggcagagggacaacggtcaccgtctcctagcctccaccaaggcccatcggtccttccccctcggcacccctcctccaagacgcacctcgtgggggcacgagccggccccctgggctcgccctggtacaaggctacttccgtatctctcgctgagcggctggcaaggcgcatagnnnnnn

SEQ ID NO: 314389 - DNA, 421 bp, Homo sapiens
  misc_feature: GZ8MTXP01B980D.11.20.B09.1.454.CMB.2.raw
  modified_base (417)..(421): a, c, t, g, unknown or other
  misc_feature (417)..(421): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctgggggcagagggacaacggtcaccgctccttagcctcaccaaggcccatcggtcttcccctggcaccctcctccaagagcacctctgggggcacagcggccccctgggctgccctggtcaagggctacttccgtatctctcgctgagcgggctggcaaggcgcatagnnnnn

SEQ ID NO: 314390 - DNA, 418 bp, Homo sapiens
  misc_feature: GZ8MTXP01ERK00.11.20.B09.1.454.CMB.2.raw
  modified_base (214)..(214): a, c, t, g, unknown or other
  misc_feature (214)..(214): n is a, c, g, or t
  modified_base (417)..(418): a, c, t, g, unknown or other
  misc_feature (417)..(418): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttcngcactctacctactacttcttctacatggacgtctggggcagagggacaacggtcaccgtctccttagcctcaccaaggcccatcggtcttccccctggcaccctcctccaagagccacctctgggggcacagcggccccctgggctgcctggtacaaggctacttccgtatctctcgctgagcggctggcaaggcgcatagnn

SEQ ID NO: 314391 - DNA, 427 bp, Homo sapiens
  misc_feature: GZ8MTXP01D4QHI.11.20.B09.1.454.CMB.2.raw
  modified_base (424)..(427): a, c, t, g, unknown or other
  misc_feature (424)..(427): n is a, c, g, or t
tcagcgagagataccacgaccggtgctcgatttagtgtagtgtgaaggggtacgtgccaagcatcctcgtgcgaccgcgagagcccggggagcggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtcgtggggcaggaggacaacggtcaccgtctctacgcctccaccaaggcccatcggtcctccccctgccaccctcctccaagacgccacctcgtgggggcacgacgcggccccccgtgggctgcctggtacaaggctacttccgtatctctcgctgagcggctggcaaggcgacatagnnnn

SEQ ID NO: 314392 - DNA, 415 bp, Homo sapiens
  misc_feature: GZ8MTXP01BE2TP.11.20.B09.1.454.CMB.2.raw
  modified_base (413)..(415): a, c, t, g, unknown or other
  misc_feature (413)..(415): n is a, c, g, or t
tcagcgagagataccacgaccggtgctcgatttagtgtagtgtgaagggtacgtgccaagcatcctcgtgcgaccgcgagagcccggggagcggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctgggggcagaggacaacggtcaccgtctccttagcctccaccaaggcccatcggtcttccccctggcaccctcctccaagagcacctctgggggcacagcgccccctgggctgcctggtcaaggctactccgtatctctcgctgagcgggctggcaaggcgcatagnnn

SEQ ID NO: 314393 - DNA, 450 bp, Homo sapiens
  misc_feature: GZ8MTXP01A9L6P.11.20.B09.1.454.CMB.2.raw
  modified_base (217)..(217): a, c, t, g, unknown or other
  misc_feature (217)..(217): n is a, c, g, or t
  modified_base (441)..(450): a, c, t, g, unknown or other
  misc_feature (441)..(450): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatcctcccgagacgattccaacaatatgttctatctgacaaatgagccgcctgagaagcaaggacacggctgtctattactgtgcgagagacggtatttcngcactctacctacttacttcttctacatggacgtcgtgggggcaggagggacaacggtcaccgtctcctacgcctccaccgaacggcccatccggtccctccccctcggccacccctcctccaagcgccacctcgtgggggcacgagccggcccccgtgggctgccctggtaacaagctactccgtatctctcgctgacgcggcgtggacaaggcgacagtagnnnnnnnnnn

SEQ ID NO: 314394 - DNA, 451 bp, Homo sapiens
  misc_feature: GZ8MTXP01AQNEM.11.20.B09.1.454.CMB.2.raw
  modified_base (441)..(451): a, c, t, g, unknown or other
  misc_feature (441)..(451): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtcgtgggggcaggagggacaacggtcaccgtctccttagcctccaccaagggcccatccggtccttccccctggccacccctcctccaagacgccaccgtcgtgggggcacgacgccggccccccgtgggctgcccgtggtacaagggtcctacttccgtatctctcgctgagcgggctggcaaggcgacatagnnnnnnnnnnn

SEQ ID NO: 314395 - DNA, 410 bp, Homo sapiens
  misc_feature: GZ8MTXP01DTIA3.11.20.B09.1.454.CMB.2.raw
  modified_base (214)..(214): a, c, t, g, unknown or other
  misc_feature (214)..(214): n is a, c, g, or t
  modified_base (405)..(410): a, c, t, g, unknown or other
  misc_feature (405)..(410): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttcngcactctacctactacttcttctacatggacgtctggggcagaggacaacggtcacgtctctagcctcaccaaggcccatcgtctcccctgcaccctcctcaagagcacctctgggggcacagcgcccctgggctgcctgtacaaggtctacttcgtatctctcgctgagcggctggcaaggcgacatagnnnnnn

SEQ ID NO: 314396 - DNA, 468 bp, Homo sapiens
  misc_feature: GZ8MTXP01BPKO1.11.20.B09.1.454.CMB.2.raw
  modified_base (214)..(214): a, c, t, g, unknown or other
  misc_feature (214)..(214): n is a, c, g, or t
  modified_base (457)..(468): a, c, t, g, unknown or other
  misc_feature (457)..(468): n is a, c, g, or t
tcagcgagagataccacgaccggtgctcgatttagtgtagtgtgaaggggtacgtgccaagcatcctcgtgcgaccgcgagagcccggggagcggggcttgccggccgattcaccatctcccgagacgattccaacaatatgttctatctgcaaatgagccgcctgagaagcaaggacacggctgtctattactgtgcgagagacggtatttcngcactctacctactacttcttctacatggacgtcgtgggggcaggagggacaacggtcaccgtctcctacgcctccaccgaacggcccatccggtccttccccctggccacccctcctaccaagacgccacccgtcgtcgggggccacgacgccggcccccgtgggctcgcccgtaggtaacaacggtccttacgttccgtatcctctcgctggacgcgggcgtgggacaagggcacagtagnnnnnnnnnnnn

SEQ ID NO: 314397 - DNA, 427 bp, Homo sapiens
  misc_feature: GZ8MTXP01ABZWH.11.20.B09.1.454.CMB.2.raw
  modified_base (410)..(427): a, c, t, g, unknown or other
  misc_feature (410)..(427): n is a, c, g, or t
tcagcgagagataccacgaccggtgctcgatttagtgtagtgtgaagggtacgtgccaagcatcctcgtgcgaccgcgagagcccggggagcggggcttgccggccgattcaccatctcccgagacgattccaacaatatgttctatctgcaaatgagccgcctgagaagcaaggacacggctgtctattactgtgcgagagacggatttctgcactctacctatacttcttctacatggacgtctgggggcagagggacaacggtcaccgtctccttagcctccaccaagggcccatcggtctcccctggcaccctctccaagagcactctgggggcacagcgccccctgggctgactggtacaaggctactccgtatctctcgctgagcggctggcaaggcgcatagnnnnnnnnnnnnnnnnnn

SEQ ID NO: 314398 - DNA, 435 bp, Homo sapiens
  misc_feature: GZ8MTXP01DLL11.11.20.B09.1.454.CMB.2.raw
  modified_base (214)..(214): a, c, t, g, unknown or other
  misc_feature (214)..(214): n is a, c, g, or t
  modified_base (430)..(435): a, c, t, g, unknown or other
  misc_feature (430)..(435): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttcngcactctacctactacttcttcacatggacgtctgggggcagagggacaacggtcaccgtctccttagcctccaccgaacggcccatccggtccttccccctggccacccctcctccaagacgcctaccctcgtgggggcacgacgccggccccctgggctgcctggtacaaggctacttccgtatctctcgctgagcggctggcaagcgcatagnnnnnn

SEQ ID NO: 314399 - DNA, 473 bp, Homo sapiens
  misc_feature: GZ8MTXP01EZ95A.11.20.B09.1.454.CMB.2.raw
  modified_base (214)..(214): a, c, t, g, unknown or other
  misc_feature (214)..(214): n is a, c, g, or t
  modified_base (462)..(473): a, c, t, g, unknown or other
  misc_feature (462)..(473): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttcngcactctacctactacttcttctacatggacgtcgtgggggcaggagggacaacggtcaccgtctcctagcctccaccgaacggcccatccggtccttccccctggccaccctcctaccaagacgccacctcgtgggggcacgacgccggcccccgtggggctcggcccgtcggtaaccgaaagggtccttaccgttccgtacttcctcctcgcttggacgccggggctgggcaagggcgacagtagnnnnnnnnnnnn

SEQ ID NO: 314400 - DNA, 436 bp, Homo sapiens
  misc_feature: GZ8MTXP01AI3L6.11.20.B09.1.454.CMB.2.raw
  modified_base (214)..(214): a, c, t, g, unknown or other
  misc_feature (214)..(214): n is a, c, g, or t
  modified_base (333)..(333): a, c, t, g, unknown or other
  misc_feature (333)..(333): n is a, c, g, or t
  modified_base (423)..(436): a, c, t, g, unknown or other
  misc_feature (423)..(436): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttcngcactctacctactacttcttctacatggacgtctgggggcaggagggacaacggtcaccgtctccttagcctccaccaagggcccatcggtcttccccctggccaccctcctccaagngcacctcgtgggggcacgagcggccccctgggctgcctggtacaaggctactccgtatctctcgctgagcgggctggcaaggcgcatagnnnnnnnnnnnnnn

SEQ ID NO: 314401 - DNA, 425 bp, Homo sapiens
  misc_feature: GZ8MTXP01DEL8I.11.20.B09.1.454.CMB.2.raw
  modified_base (213)..(213): a, c, t, g, unknown or other
  misc_feature (213)..(213): n is a, c, g, or t
  modified_base (325)..(325): a, c, t, g, unknown or other
  misc_feature (325)..(325): n is a, c, g, or t
  modified_base (414)..(425): a, c, t, g, unknown or other
  misc_feature (414)..(425): n is a, c, g, or t
tcagcgagagataccacgaccggtgctcgatttagtgtagtgtgaagggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttcngcactctacctactacttcttctacatggactctgggggcaggagggacaacggtcaccgtctcctagcctccaccaaggcccatcggtctccccctgcaccctcctcaagngcacctcgtgggggcacagcgccccctgggctgcctggtacaagggctactccgtatctctcgctgagcggactggcaaggcgcatagnnnnnnnnnnnn

SEQ ID NO: 314402 - DNA, 427 bp, Homo sapiens
  misc_feature: GZ8MTXP01D9FPV.11.20.B09.1.454.CMB.2.raw
  modified_base (326)..(326): a, c, t, g, unknown or other
  misc_feature (326)..(326): n is a, c, g, or t
  modified_base (418)..(427): a, c, t, g, unknown or other
  misc_feature (418)..(427): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctgggggcaggagggacaacggtcaccgtctcctagcctacaccaaaggcccatcggtctcccctgcaccctctccaanagcactcgtgggggcacacgcggccccctgggctgcctggtacaacggctacttccgtatctctcgctgagcggctggcaaggcgacaatgnnnnnnnnnn

SEQ ID NO: 314403 - DNA, 507 bp, Homo sapiens
  misc_feature: GZ8MTXP01BO5LO.11.20.B09.1.454.CMB.2.raw
  modified_base (491)..(507): a, c, t, g, unknown or other
  misc_feature (491)..(507): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccgaacggccccatccggtccttccccccgtggcccacccctcctaccaacgacgccacctcgtcgggggccacgacgccggcccccgtggggctcgcccgttacggtaaccgaaacgggtaaccttaccgtttacccggttattcccgtccgttcggcgttcgggacggtccggggcgtcgggacgaacggcgacgaatagnnnnnnnnnnnnnnnnn

SEQ ID NO: 314404 - DNA, 457 bp, Homo sapiens
  misc_feature: GZ8MTXP01EMQG6.11.20.B09.1.454.CMB.2.raw
  modified_base (213)..(213): a, c, t, g, unknown or other
  misc_feature (213)..(213): n is a, c, g, or t
  modified_base (337)..(337): a, c, t, g, unknown or other
  misc_feature (337)..(337): n is a, c, g, or t
  modified_base (432)..(432): a, c, t, g, unknown or other
  misc_feature (432)..(432): n is a, c, g, or t
  modified_base (439)..(457): a, c, t, g, unknown or other
  misc_feature (439)..(457): n is a, c, g, or t
tcagcgagagataccacgaccggtgctcgatttagtgtagtgtgaaggggtacgtgccaagcatcctcgtgcgaccgcgagagcccggggagcggggcttgccggccgattcaccatctcccgagacgattccaacaatatgttctatctgcaaatgagccgctgaagaagcaaggcacggctgtctattactgtgcgagagacggattttcngctactcctaacctactacttcttctacagtggacgtcgtggggctaggagggacaaacggtcaccgtctccttacgcctccaccgaaggcccatcggtcctcccctggcaccctctaccaagngccacctcgtgggggcacgacgccgccccctggggctcgcctcggtaacaacgggtctactttccgtatcctctcgctgagcggctggcaaggcnctagagnnnnnnnnnnnnnnnnnnn

SEQ ID NO: 314405 - DNA, 510 bp, Homo sapiens
  misc_feature: GZ8MTXP01B0EGR.11.20.B09.1.454.CMB.2.raw
  modified_base (214)..(214): a, c, t, g, unknown or other
  misc_feature (214)..(214): n is a, c, g, or t
  modified_base (480)..(486): a, c, t, g, unknown or other
  misc_feature (480)..(486): n is a, c, g, or t
  modified_base (488)..(510): a, c, t, g, unknown or other
  misc_feature (488)..(510): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttcngcactctacctactacttctctacatggactcgtggggcagagggacaacggtcaccgtctctagcctccaccgaacgggccccatccggtccttccccctcggccacccctcctaccaacgcgcacccgtcgtgggggccacgacggccggcccccgtcggggctcggcccgttgggtaaccgaaacgggtccttaaccgtttcccgtaacttccgtccgttccgcgtggacggcggggctcgggacgaaggcgtacgaagtcgnnnnnnngnnnnnnnnnnnnnnnnnnnnnnn

SEQ ID NO: 314406 - DNA, 486 bp, Homo sapiens
  misc_feature: GZ8MTXP01DBW6N.11.20.B09.1.454.CMB.2.raw
  modified_base (215)..(215): a, c, t, g, unknown or other
  misc_feature (215)..(215): n is a, c, g, or t
  modified_base (467)..(486): a, c, t, g, unknown or other
  misc_feature (467)..(486): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggtatttcngcactctacctactacttcttctacatggacgtcgtgggggcaggagggacaacggtcaccgtctccttacgcctccaccgaacggcccatccggtccttccccctcggccacccctcctaccaagacgccaccctcggtgggggccacgcggccggccccccgtgggctcgcccgtgggtaaccaaacggtccttacttcccgtatcctctcgctggacggcgggcgtcgggacgaacgggcgacagtagnnnnnnnnnnnnnnnnnnnn

SEQ ID NO: 314407 - DNA, 417 bp, Homo sapiens
  misc_feature: GZ8MTXP02IK7U4.11.20.B09.1.454.CMB.2.raw
  modified_base (413)..(417): a, c, t, g, unknown or other
  misc_feature (413)..(417): n is a, c, g, or t
tcagcgagagataccacgaccggtgctcgatttagtgtagtgtgaagggtacgtgccaagcatcctcgtgcgaccgcgagagcccgggagcggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtcttccccctggcaccctcctccaagagcacctctggggcacagcggcccctgggctgcctggtcaaggctacttccgtatctctcgctgagcgggctggcaaggcgcatagnnnnn

SEQ ID NO: 314408 - DNA, 412 bp, Homo sapiens
  misc_feature: GZ8MTXP02JCZ0G.11.20.B09.1.454.CMB.2.raw
  modified_base (410)..(412): a, c, t, g, unknown or other
  misc_feature (410)..(412): n is a, c, g, or t
tcagcgagagataccacgaccggtgctcgatttagtgtagtgtgaagggtacgtgccaagcatcctcgtgcgaccgcgagagcccgggagcgggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaaggcccatcggtctcccctggcaccctcctccaagagcacctctggggcacagcggcccctgggctgcctggtcaagggctacttccgtatctctcgctgagcgggctggcaaggcgcatagnnn

SEQ ID NO: 314409 - DNA, 413 bp, Homo sapiens
  misc_feature: GZ8MTXP02HQTII.11.20.B09.1.454.CMB.2.raw
  modified_base (410)..(413): a, c, t, g, unknown or other
  misc_feature (410)..(413): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaaggccatcggtcttcccctgcaccctcctccaagagcacctctggggcacagcggcccctgggctgcctggtcaaggctacttcgatctctcgctgagcgggctggcaaggcgcatagnnnn

SEQ ID NO: 314410 - DNA, 413 bp, Homo sapiens
  misc_feature: GZ8MTXP02IQZTY.11.20.B09.1.454.CMB.2.raw
  modified_base (413)..(413): a, c, t, g, unknown or other
  misc_feature (413)..(413): n is a, c, g, or t
tcagcgagagataccacgaccggtgctcgatttagtgtagtgtgaagggtacgtgccaagcatcctcgtgcgaccgcgagagcccggggagcggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaaggccccatcggtcttccccctggcaccctcctccaagagcacctctggggcacagcggcccctgggctgcctggtcaaggctacttccgtatctctcgctgagcggctggcaaggcgcatagn

SEQ ID NO: 314411 - DNA, 423 bp, Homo sapiens
  misc_feature: GZ8MTXP02HNT3Q.11.20.B09.1.454.CMB.2.raw
  modified_base (420)..(423): a, c, t, g, unknown or other
  misc_feature (420)..(423): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtcttccccctggcaccctcctccaagagcacctctgggggcacagcggccccctggggctgcctggtcaagggctacttccgtatctctcgctgagcgggctggcaaggcgcatagnnnn

SEQ ID NO: 314412 - DNA, 427 bp, Homo sapiens
  misc_feature: GZ8MTXP02JZ2V5.11.20.B09.1.454.CMB.2.raw
  modified_base (419)..(427): a, c, t, g, unknown or other
  misc_feature (419)..(427): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtctccccctggcaccctcctccaagacgcacctctgggggcacagcggccccctgggctgcctggtcaagggctacttccgtatctctcgctgagcgggctggcaaggcgcatagnnnnnnnnn

SEQ ID NO: 314413 - DNA, 419 bp, Homo sapiens
  misc_feature: GZ8MTXP02HDJ23.11.20.B09.1.454.CMB.2.raw
  modified_base (413)..(419): a, c, t, g, unknown or other
  misc_feature (413)..(419): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaaggcccatcggtcttccccctggcaccctcctccaagagcacctctggggcacagcgccccctggctgcctggtcaaggctacttcgtatctctcgctgagcgggctggcaaggcgcatagnnnnnnn

SEQ ID NO: 314414 - DNA, 419 bp, Homo sapiens
  misc_feature: GZ8MTXP02GMRYO.11.20.B09.1.454.CMB.2.raw
  modified_base (416)..(419): a, c, t, g, unknown or other
  misc_feature (416)..(419): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtctccccctggcaccctcctccaagagcacctctgggggcacagcggccccctggctgcctggtcaaggctacttccgtatctctcgctgagcgggctggcaaggcgcatagnnnn

SEQ ID NO: 314415 - DNA, 419 bp, Homo sapiens
  misc_feature: GZ8MTXP02GH5BA.11.20.B09.1.454.CMB.2.raw
  modified_base (416)..(419): a, c, t, g, unknown or other
  misc_feature (416)..(419): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtcttccccctggcaccctcctccaagagcacctctggggcacagcggcccctgggctgcctggtcaaggctacttccgtatctctcgctgagcgggctggcaaggcgcatagnnnn

SEQ ID NO: 314416 - DNA, 411 bp, Homo sapiens
  misc_feature: GZ8MTXP02IPOZQ.11.20.B09.1.454.CMB.2.raw
  modified_base (409)..(411): a, c, t, g, unknown or other
  misc_feature (409)..(411): n is a, c, g, or t
tcagcgagagataccacgaccggtgctcgatttagtgtagtgtgaaggggtacgtgccaagcatcctcgtgcgaccgcgagagcccggggagcggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagaggacaacggtcacgtctccttagcctcaccaaggcccatcggtcttccccctgcaccctcctccaagagcacctctggggcacagcggcccctgggctgcctggtcaaggctacttcgtatctctcgctgagcgggctggcaaggcgcatagnnn

SEQ ID NO: 314417 - DNA, 436 bp, Homo sapiens
  misc_feature: GZ8MTXP02J1E8E.11.20.B09.1.454.CMB.2.raw
  modified_base (432)..(436): a, c, t, g, unknown or other
  misc_feature (432)..(436): n is a, c, g, or t
tcagcgagagataccacgaccggtgctcgatttagtgtagtgtgaaggggtacgtgccaagcatcctcgtgcgaccgcgagagcccggggagcggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagaggacaacggtcaccgtctccttagcctccaccaagggccccatccggtcttcccccctggccacccctcctcccaagagcaccctctcgggggcacagccggccccctggggctgccctggtcaagggcctacttcccgtatctctcgctgagtcgggctgggcaaggcgcatagnnnnn

SEQ ID NO: 314418 - DNA, 420 bp, Homo sapiens
  misc_feature: GZ8MTXP02IONQ2.11.20.B09.1.454.CMB.2.raw
  modified_base (413)..(420): a, c, t, g, unknown or other
  misc_feature (413)..(420): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagaggacaacggtcaccgtctccttagcctccaccaaggcccatcggtctcccctgcaccctcctccaagacgcacctctggggcacagcggccccctgggctgcctggtcaaggctacttccgtatctctcgctgagcgggctggcaaggcgcatagnnnnnnnn

SEQ ID NO: 314419 - DNA, 464 bp, Homo sapiens
  misc_feature: GZ8MTXP02GE80L.11.20.B09.1.454.CMB.2.raw
  modified_base (214)..(214): a, c, t, g, unknown or other
  misc_feature (214)..(214): n is a, c, g, or t
  modified_base (450)..(464): a, c, t, g, unknown or other
  misc_feature (450)..(464): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttcngcactctacctactacttcttctacatggacgtcgtggggcagaggacaacggtcaccgtctccttagcctccaccgaacgggccccagtccggtccttcccccgtggccctaccccgtcctaccaagacgccacctcggtgggggccacgacggccggcccccgtgggctcgccgtggtaccaagggtcctacttccgtatcctctcgctggagcgggctggcaaggcgcatagnnnnnnnnnnnnnnn

SEQ ID NO: 314420 - DNA, 482 bp, Homo sapiens
  misc_feature: GZ8MTXP02IA0CC.11.20.B09.1.454.CMB.2.raw
  modified_base (211)..(211): a, c, t, g, unknown or other
  misc_feature (211)..(211): n is a, c, g, or t
  modified_base (247)..(247): a, c, t, g, unknown or other
  misc_feature (247)..(247): n is a, c, g, or t
  modified_base (338)..(338): a, c, t, g, unknown or other
  misc_feature (338)..(338): n is a, c, g, or t
  modified_base (462)..(482): a, c, t, g, unknown or other
  misc_feature (462)..(482): n is a, c, g, or t
tcagcgagagataccacgaccggtgctcgatttagtgtagtgtgaaggggtacgtgccaagcatcctcgtgcgaccgcgagagccggggagcggggcttgccggccgattcaccatctcccgagacgattccaacaatatgttctatctgcaaatgagccgcctgagaagcaaggacacggctgtctattactgtgcgagagacgatttcngcactctacctactacttcttctacatggacgtcgnggggacaggaggacaacggtcaccgtctccttacgcctccaccgaacggccccagtccggtcccttccccgtgcccacccctcctcaagcncaccgtgcggggcacgcggccgcccctgggcctcgccgtggtacaaacgggtcctaaccgtttcgtacttccgtccgtcgtcgtggacggtcgggccgtcgggacgaacgggcctagaacgtgnnnnnnnnnnnnnnnnnnnnn

SEQ ID NO: 314421 - DNA, 414 bp, Homo sapiens
  misc_feature: GZ8MTXP02IV3G6.11.20.B09.1.454.CMB.2.raw
  modified_base (410)..(414): a, c, t, g, unknown or other
  misc_feature (410)..(414): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaaggcccatcggtctccccctggcaccctcctccaagagcacctctgggggcacagcgccccctggctgcctgtcaaggctactcgtatctctcgctgagcggctggcaaggcgcatagnnnnn

SEQ ID NO: 314422 - DNA, 403 bp, Homo sapiens
  misc_feature: GZ8MTXP02IJZYI.11.20.B09.1.454.CMB.2.raw
  modified_base (214)..(214): a, c, t, g, unknown or other
  misc_feature (214)..(214): n is a, c, g, or t
  modified_base (315)..(315): a, c, t, g, unknown or other
  misc_feature (315)..(315): n is a, c, g, or t
  modified_base (397)..(403): a, c, t, g, unknown or other
  misc_feature (397)..(403): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttcngcactctacctactacttcttctacatggacgtctggggcagagggacaacggcacgtctctagcctcacaaggccatcgctcccctgcacctcctcaagncacctcgtggggcacagcgcccctgggctgcctgtcaaggctacttccgtatctctcgctgagcggctgcaaggcgcatagnnnnnnn

SEQ ID NO: 314423 - DNA, 426 bp, Homo sapiens
  misc_feature: GZ8MTXP02FXMIH.11.20.B09.1.454.CMB.2.raw
  modified_base (417)..(426): a, c, t, g, unknown or other
  misc_feature (417)..(426): n is a, c, g, or t
tcagcgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcaggagggacaacggtcaccgtctcctagcctccaccaggcccatcggtctccccctggccaccctcctccagacgcacctcgtggggcacagccggccccctgggctgcctggtcaagctacttcgtatctctcgctgacgcgggctggacaaggcgcatagnnnnnnnnnn

SEQ ID NO: 314424 - DNA, 429 bp, Homo sapiens
  misc_feature: GZ8MTXP02JXZHM.11.20.B09.1.454.CMB.2.raw
  modified_base (329)..(329): a, c, t, g, unknown or other
  misc_feature (329)..(329): n is a, c, g, or t
  modified_base (417)..(429): a, c, t, g, unknown or other
  misc_feature (417)..(429): n is a, c, g, or t
tcagcgagagataccacgaccggtgctcgatttagtgtagtgtgaaggggtacgtgccaagcatcctcgtgccaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaaggcccatcggtcttcccctggcaccctcctccaagancacctctggggcacagcggcccccctgggctgcctggcaaggcctacttccgtatctctcgctgagcgggcgtggcaaggcgcatagnnnnnnnnnnnnn

SEQ ID NO: 314425 - DNA, 593 bp, Homo sapiens
  misc_feature: GZ8MTXP01A3A0L.52.4.A04.1.454.CMB.2.raw
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgttctggtatcgccagaagccaggccagtcgctgtcctggtcatctatcacgataagaagccggcctcgagggactcccgtagacgcgattccgtctcgggaccttccgaaacttcgtaggggaaaccacgacggcccaactcctagaaccccagtccgaaggcccggggaaaccccgaggtacctagtaggacgtaggacggtactacggggtaactttacgttacgtacgtaccgacggtccggtagggaacgacggtacgtctacgtcgtgggttcggttcggggacgggacggaccgtggttccgttcggacccgtcgtacggcacggcccgacggtccgttccggtccccg

SEQ ID NO: 314426 - DNA, 501 bp, Homo sapiens
  misc_feature: GZ8MTXP01ESGSA.52.4.A04.1.454.CMB.2.raw
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (380)..(380): a, c, t, g, unknown or other
  misc_feature (380)..(380): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgtctgagataaaatggagataaatatgttcnggtatcgcagaanccaggccagtcgcctgtcctggtcatctatcacgataagaacgcggcccctnagggatccctgagcgatctctggctcaaatcngggaacacagcactctnacacncacgacgacgacgacagagagngagcgtacgtactatactcgtcgcgcgtacggacgagtagacgtacgtcgtcggtcggttcggtcgggacgggacgacggcgcgacgtccgtacgtcgacgaccgacgtcgttccgtcccg

SEQ ID NO: 314427 - DNA, 571 bp, Homo sapiens
  misc_feature: GZ8MTXP01B12MG.52.4.A04.1.454.CMB.2.raw
  modified_base (429)..(429): a, c, t, g, unknown or other
  misc_feature (429)..(429): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgtctggagaataaatggagataaatatgttcctggtatcgccagaagccaggccagtcgcctgtcctggtcatctatcacgataagaagcggaccctgagggactccctggagcgtatttcctcgtcgggccttcccaaacgtccgtaggggaaaccacgacggaccctaactctacgacccaacgtcgaacggcccggggaaccccagggaccttaaggnggagtacggacggtcgtaggtactttattacgtgtacgacggtccggtaggaacagtacgctacgtgtcggtggttcgggcgggacggacgtcggcgttcgacccgtcgtacggtcacgccggacgtccgttccggtccccg

SEQ ID NO: 314428 - DNA, 563 bp, Homo sapiens
  misc_feature: GZ8MTXP01BF8SN.52.4.A04.1.454.CMB.2.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (325)..(325): a, c, t, g, unknown or other
  misc_feature (325)..(325): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagaataaagtggagataaatntgttcngtancgcagagcaggccagtcgctgtcctggtcatctatcacgataagacgccggccctgaggactccgtgacgtcgtattcncgtcggccctccaaacgtccgtagggaaccacgacgccctactctacgaccctaagtccgacgggcccgggaacccagggtcctaagtggagtggaacggtctacggggtacttaagttaccgttggtacgacggccggtagggaacacggaacgcctaccgtgtgggtcgttcggggcggacgggaccgagggcttcggaccgtcgtaggccacgcccgaggtcccgttcgtccccg

SEQ ID NO: 314429 - DNA, 498 bp, Homo sapiens
  misc_feature: GZ8MTXP01D9V5L.52.4.A04.1.454.CMB.2.raw
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccaccgtcagtgtccgtctccccaggacagacagccagcatcagctgttctggagataaaatggaagataaatatgttcctggtatcgcagaagccaggccagtcgcctgtcctggtcatctatcacgataagaagcggccctcgagggactcccgtgagcgattctctggctccaactcgtagggaacacagccactctgaccatcagcggacccaggctanggatggagcnggactntactgtcagccgtgggaacngaagcactcgtaaggtgttcgggcgggaggccaggcgttgaccgtccgtaggtcgacgcccaggtccttcgccccg

SEQ ID NO: 314430 - DNA, 558 bp, Homo sapiens
  misc_feature: GZ8MTXP01BRZCU.52.4.A04.1.454.CMB.2.raw
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
tcagcgcagtacgacacgaccggtgctcgatttagagtagtgatcaggggctgggcctcaggaagcagcatcggaggtgcctcagccatggcatggatccctctcttcctcctcgtccttgcttactgcacaggatgtgtggcctcctatgaggtgactcagacaccgtcagtgtccgtctccccaggacagacagccagcatcagctgttctggagataaaatggagataaatatgttctggtatcgcagaagcaggcagtcgctgtcctggtcatctatcacgataagaagcggccctgagggactccgtgagtcgattctctcggcctccaaactcgtagggaacacacgccactctgaccctancgacggaccggaccaggtactagnggatggacgcgtacggtaacttagttacgtgtaccgcggtccggtaggaacaagacgtccgtacgtggttgggtcgggttcggggcgggaacgggtaccgacgggttccgttcggaccggttccggtacggtccgaccggaccgacggtcccgttcccggtccccg

SEQ ID NO: 314431 - DNA, 571 bp, Homo sapiens
  misc_feature: GZ8MTXP01B9NT0.52.4.A04.1.454.CMB.2.raw
  modified_base (215)..(215): a, c, t, g, unknown or other
  misc_feature (215)..(215): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (282)..(282): a, c, t, g, unknown or other
  misc_feature (282)..(282): n is a, c, g, or t
  modified_base (315)..(315): a, c, t, g, unknown or other
  misc_feature (315)..(315): n is a, c, g, or t
  modified_base (318)..(318): a, c, t, g, unknown or other
  misc_feature (318)..(318): n is a, c, g, or t
  modified_base (420)..(420): a, c, t, g, unknown or other
  misc_feature (420)..(420): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtgtccgtctcccaggacagacagccagcatcagctgttctgganataaagtggaagataaatatgttccnggtancgcagacgcaggcagtcgcctgtcctggtcatctancaacgataagaacgcgaccctgagggactccgngancgtattctcgtcggccttccaaacgttcgacgggaaaccacacgacctaacttccacgaaccagtaccgaccggacggggaacccttagggaccttaagggnggaacgtggacgtacgtacgggtaacttacgtacgtcgtacgacggtcggaggaacgagtacgcgtacgtggtgggtcggttacgggacgggacggacgtcggttcgttcggacccgtgacgtcgacggaccgacggtccgcccggtcccg

SEQ ID NO: 314432 - DNA, 584 bp, Homo sapiens
  misc_feature: GZ8MTXP01CRGM4.52.4.A04.1.454.CMB.2.raw
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (524)..(524): a, c, t, g, unknown or other
  misc_feature (524)..(524): n is a, c, g, or t
  modified_base (531)..(531): a, c, t, g, unknown or other
  misc_feature (531)..(531): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccaccgtcagtgtccgtcctccccaggacagacagccagcatcagctgttcngganaataaagnggagataaatntgttcngtatcgcagancaggccagtcnctgtcctgtcatctatcacgataaagaacgccggacctgagggtactcccgtagagcgtatttcctacgtcgggcctaacccgtaagtcccgtaggggaaaccacgacgacccacttccgtaagaccccagtaccgaacgggcccgggggaacccaggggtacctaaggtgggaattcgggaacggtcctagggtacttaatttccgaggtccgagccggtaggaacagacgctaccgtggtggtcggttcgggcggnggaaccnggaccgttggacccgttccgaggtccaacgcccgaggtcccgttccgccccgg

SEQ ID NO: 314433 - DNA, 498 bp, Homo sapiens
  misc_feature: GZ8MTXP01C0TEG.52.4.A04.1.454.CMB.2.raw
  modified_base (211)..(211): a, c, t, g, unknown or other
  misc_feature (211)..(211): n is a, c, g, or t
  modified_base (287)..(287): a, c, t, g, unknown or other
  misc_feature (287)..(287): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
tcagcgcagtacgacacgaccggtgctcgatttagagtagtgatcaggggtgggcctcaggaagcagcatcggaggtgcctcagccatggcatggatccctctcttcctcggcgtccttgcttactgcacaggatgtgtggcctctatgaggtgactcagacaccgtcagtgtccgtctccccaggacagacagccagcatcagctgttcnggagaataaaagtggagataaatatgttcctggtatcgcagaagccaggccagtcgctgtcctggtcatctatcanataagagcgcctgaggactccngacncgattcnctggactaccaacgtctagggaactacgagccactcgtanacancagcgaccaggctagtgatgaggctagatatactgtcagtcgagacagagctagtcgtggtgtcgggaggtacggaccgtaggcgttcgccgttcgtaagggacctcggaccgtacggccgtccgccccgtcgg

SEQ ID NO: 314434 - DNA, 631 bp, Homo sapiens
  misc_feature: GZ8MTXP01ELX0N.52.4.A04.1.454.CMB.2.raw
  modified_base (218)..(218): a, c, t, g, unknown or other
  misc_feature (218)..(218): n is a, c, g, or t
  modified_base (425)..(425): a, c, t, g, unknown or other
  misc_feature (425)..(425): n is a, c, g, or t
  modified_base (538)..(538): a, c, t, g, unknown or other
  misc_feature (538)..(538): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccaggacagacagccagcatcagctgttctgganaataaatggagataaatatgttctggtatcgcagagcagccagtcgctgtctggtcatctatcacgataagaagcggcctagacgggactcccgtgacggtctacttctcgtcggcctccaactcgtacggggaaacacgacgccctaactctacgaacctagtccgacggacccgggaaccccaggggtacctaaggtcggtaagnggtaacgggtctacggggtaactttaaggttacctaggtccgacgtcccggtagggaacaaggtaacggcctaacggttgtcgggtcggtttcggggacgggaggggaacccncggggttaccgttccggttaacccgggttccggaacgggttaacccgacgggaccccgttaacgggtccccgtttaaccgggtccccccccgg

SEQ ID NO: 314435 - DNA, 533 bp, Homo sapiens
  misc_feature: GZ8MTXP01DN2XK.52.4.A04.1.454.CMB.2.raw
  modified_base (212)..(212): a, c, t, g, unknown or other
  misc_feature (212)..(212): n is a, c, g, or t
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
  modified_base (524)..(524): a, c, t, g, unknown or other
  misc_feature (524)..(524): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtgtccgtctccccaggacagacagccagcatcagctgttcnggaagaataaaagtggaagaattaaatatgtttcctggtatcgcagaagcaggccagtcgctgcctggtcatctatcaacgataagaacgccggccctcgagggactcccgtgagcgtattctcgtcggccttccaaactctacgggaaacacgacgcctacctctgaccagtcacggcgggacccaggctagtgagtggagtctaggacttagttactgtacncgcgtgggaacagtaacnctactcgtggtgttcgggcgggttagggaccagggcgttcggaccgtcgtaagccgacgcccgaggtccncggtccccg

SEQ ID NO: 314436 - DNA, 643 bp, Homo sapiens
  misc_feature: GZ8MTXP01DM8EQ.52.4.A04.1.454.CMB.2.raw
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (369)..(369): a, c, t, g, unknown or other
  misc_feature (369)..(369): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtccgtctccccaggacagacagccagcatcagctgttctgganaataaagtggaagataaatntgttcnggtatcgcagagccaggcagtcgctgtcctgtcatctatcacgataacgagccggcctagagggactccccgtgacggtcgtatttcctacgtacgggccctccgaaactccggtacgggaaaccnccgagaccctaacttctacgaacccgtataccgacggacccggggaacccagggcctaagggtcggaatagggacgggtacctaggggttaaccttagtttacctgggtacaaccgggcggtacggggaactaggaactcgtcggttcgtgggttcggttcggggacccggggagggtacccgtaaggggcccgttacgggaaccccgggtttccgttaaacgggtcgaacccgggacccgttaacggggccctttaaccccggtcccccccgg

SEQ ID NO: 314437 - DNA, 603 bp, Homo sapiens
  misc_feature: GZ8MTXP01B02H5.52.4.A04.1.454.CMB.2.raw
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (331)..(331): a, c, t, g, unknown or other
  misc_feature (331)..(331): n is a, c, g, or t
  modified_base (392)..(392): a, c, t, g, unknown or other
  misc_feature (392)..(392): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacacgtcagtgtccgtctcccaggacagacagccagcatcagctgttctgganaataaaagtggagaataaatntgttcngtatcgcagagcaggccagtcgctgtcctggtcatctatcacgataagagccggcctacgaggggactcccgtaggacgtcgtacttccncgttacgggccctccgaaacttcgtacgggaaaccacgtacgccctaactctacgacctancgaacgggcccgggaacccagggtactagtggatcggaagtctacgggtaactttagttaccgtggttaccgacggtccggttagggaaccgaaggaacgtccgtaacgtccggttaagggtcggtttccggggcgggttacgggaccgtacgggttcgttcggacccgtcgtaggtccgacgcccggaaggtccccgttcggtcccccgg

SEQ ID NO: 314438 - DNA, 657 bp, Homo sapiens
  misc_feature: GZ8MTXP01CVM3P.52.4.A04.1.454.CMB.2.raw
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (527)..(527): a, c, t, g, unknown or other
  misc_feature (527)..(527): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccgaggacagacagccagcatcagctgttctaggaanaataaaanggaagtaataaatntgttcnggtatcgcagacgcagccagtcgctgtcctggtcatctatacaacgataaacgaacgccggaccctagaacgggtctcccgtaggacgtcgtatttccgtcgtcgggacccttccgaaaccgtcggtaaacgggaaccacgacgccctaacgtctacgaacctagacgaaccggacccggggaaccacgggtaccttaaggtcgggaactgggaacggtccgttaggggtaacctttaacgttaccgtgtaaccgacggtcccgggttaggaaaccgngaaacggtcctaacgtcgttaaggggtcggttcgggggacgggacgggacccgtagggccgttccggttacccggtgtaaccggggtcaccgggggtaccccaaggggtccccttcccggtccccccggg

SEQ ID NO: 314439 - DNA, 627 bp, Homo sapiens
  misc_feature: GZ8MTXP01ELVA3.52.4.A04.1.454.CMB.2.raw
  modified_base (212)..(212): a, c, t, g, unknown or other
  misc_feature (212)..(212): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtgtccgtctccccaggacagacagccagcatcagctgttcnggagaataaagtggagataaatntgttcngtatcgcagancagccagtcgctgctgtcatctatcacgataagaagccggccctgaggactccgtgagcgtattccgtctcggcctcccgaaactcgtagggaaccacgacgaccctacttccacgaaccagtccgaacggcccggggaaccctagggaccttaagcggagtggaacgggtctagggtaacttagtttaccgttcgtacgaaccggtccgggttaggaaccgtaagaaaccggtctaaccggtccgggttgggttcggttacgggggcgggaacggggaccgaacgggttcccggttaacggccccgggttaacgttaccggggtaaccgaccgggaccccggttaacggcccgtttaacccggtcccccccggg

SEQ ID NO: 314440 - DNA, 541 bp, Homo sapiens
  misc_feature: GZ8MTXP01BFH5H.52.4.A04.1.454.CMB.2.raw
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtgtccgtctccccaggacagacagccagcatcagctgttctgganaataaatggagataaatntgttccnggtatcgcagagcagcagtcnctgtcctgtcatcatcacgataaggaacgcggccctanagggtctcccgtgacgcgatttctcgtggcctccgaaacgtcgtagggaaaccncgagcccactctagaccatccgaaggccggaacccgaggtctaagtggatgaggtctagggtacttattacngtacncggtccggtaggacagtaacgctagtctgggtacgttcggggcgttacggggaccacggttcgttccggacgtccgtaggccacggaccgacggtccgttccgtcccccg

SEQ ID NO: 314441 - DNA, 559 bp, Homo sapiens
  misc_feature: GZ8MTXP01EVSC9.52.4.A04.1.454.CMB.2.raw
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
  modified_base (324)..(324): a, c, t, g, unknown or other
  misc_feature (324)..(324): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
tcagcgcagtacgacacgaccggtgctcgatttagagtagtgatcaggggctgggcctcaggaagcagcatcggaggtgcctcagccatggcatggatccctctcttcctcctcgtccttgcttactgcacaggatgtgtggcctctatgaggtgactcagacaccgtcagtgtccgtctccccaggacagacagccagcatcagctgttcnggagataaaanggaagataaatatgttctggtatcgcagagcaggcagtcgctgtcctgtcatctatcacgaataagaagcggaccctgaggactcccgtgacgcgattccncgtcggctcccgaaactcgtacgggaacacgacgccaactcagaacccagtacgaacgcggggaacccaaggtcctagnggancggaagctaggaacttattacgtcgacagccggttagggaacaggtaaacgcgtacgtcgtggtcggttcgggacggacgggacgtacggttcgttcggttacccgtcggtacggtaaccgacggcccgttaacggtccgttcccgtccccg

SEQ ID NO: 314442 - DNA, 663 bp, Homo sapiens
  misc_feature: GZ8MTXP01DNQO1.52.4.A04.1.454.CMB.2.raw
  modified_base (246)..(246): a, c, t, g, unknown or other
  misc_feature (246)..(246): n is a, c, g, or t
  modified_base (320)..(320): a, c, t, g, unknown or other
  misc_feature (320)..(320): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccaccgtcagtgtcccgtctccccaggacagacagccagcatcagctgttctaggaagaataaaagtgggaaggaattaaatnttgttcctggtatcgcagaagccaggccagtcgctgtcctggtcatctatcacgataagaagcggcctgagggntcccgtgagcgtattcctcgtacggccttccaaactcgtagggaaaccacgacgccactctacgaaccctagtcgaacggccggggaaccccagggtacctagtgggaactggaagggtccttaggggaacctttaacgttaaccgccttacgacggtccccgggtaggggaaacctacggaaacggcctaaccgttcgggttaacgggtcgggtttccgggggaccggggaaacgggtaacccgcggggttcccgttcgggttaaccccgggttcccgttaaacggggttcccgaacggggtccccgaaacggggtccccgttaacccgggtccccccccgg

SEQ ID NO: 314443 - DNA, 595 bp, Homo sapiens
  misc_feature: GZ8MTXP01BYGJO.52.4.A04.1.454.CMB.2.raw
  modified_base (216)..(216): a, c, t, g, unknown or other
  misc_feature (216)..(216): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtgtccgtctccccaggacagacagccagcatcagctgttctgganaataaagtggaagaattaaatattgttcctggtatcgccaagaagccaggccagtccgcctgtcctggtcatctatcgacgataagaacgcggccctagaggactccgtgacgtcgatttcctcgtacggcctaacccaaacgtcgtacgggaaccacgacggccctaactcgtacgaacctatcgacggaccgggaaccccagggtcctaaggtggatcggaaggtctacgggtaacttacgttacgtcgtacgacggtccggtagggaacgtaggaacgctacgtggtaacgggtcggttcgggacggggttacgggaccgagggttcgttcggaccggtcgtaggtccacggccgacgggtccgttccggtccccg

SEQ ID NO: 314444 - DNA, 598 bp, Homo sapiens
  misc_feature: GZ8MTXP01DVPXC.52.4.A04.1.454.CMB.2.raw
  modified_base (155)..(155): a, c, t, g, unknown or other
  misc_feature (155)..(155): n is a, c, g, or t
  modified_base (169)..(169): a, c, t, g, unknown or other
  misc_feature (169)..(169): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (529)..(529): a, c, t, g, unknown or other
  misc_feature (529)..(529): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtnactcagacaccgtnagtcgtccgtctcccgaggacagacagccagcatcagtctgtctaggaataataaagtggaagtaattaaatnttcgttcnggtactcgacagacgccgagcagtcgctgcctgtcatctatcaagtataacggacgccggtcctagacggtactcccgtaggacgtcgtacttctccgtcgggtaccctaaccgaacgtcggtaacgggaaaccacgacgaccctactctacgaaccctagaccgacgggacccgggaacccgtaggtacttaggaggacgtggaacggtctaagggtaactttagttacgtcgtaacgcggtccggaggactagacgtctagtcggtaagggttcggnggggacggttaggaccgtggttccgttcgttaccgtcgtacgcacggcccgagtcccgttccgtccccg

SEQ ID NO: 314445 - DNA, 692 bp, Homo sapiens
  misc_feature: GZ8MTXP01AOV3V.52.4.A04.1.454.CMB.2.raw
  modified_base (215)..(215): a, c, t, g, unknown or other
  misc_feature (215)..(215): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtgtccgtctcccaggacagacagccagcatcagctgttctgganaataaagtggaagaataaatntgttcnggtatcgcagaagccaggccagtcgctgtcctggtcatctatcaacgtataaggaacgccgggaccctacgaaggggacttcccgtaggacgtcgtacttccgtccgtaacgggcccttaacccgaaacgttcccggtaaaggggaaacccacgtaacggacccctaaaccttccgtacggaaccctagtacccggaacgggacccggggaaaccccagggtaccttaaggtagggacttgggaacgggtcgttaacggggtaactttaacgttaaccgtcggttaccgacggtacccggtaggggaaccaaaggtaaccgcctacgttcgggtcgggttcggggttccggggaacgggacggggaaccgtacggggttccgttaccgggacccgttaaccggacggtccgaaccggaccccgggaagtcccgttaacccggtccccccg

SEQ ID NO: 314446 - DNA, 528 bp, Homo sapiens
  misc_feature: GZ8MTXP01A4Z46.52.4.A04.1.454.CMB.2.raw
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
tcagcgcagtacgacacgaccggtgctcgatttagagtagtgatcaggggtgggcctcaggaagcagcatcggaggtgcctcagccatggcatggatccctctcttcctcggcgtccttgcttactgcacaggatgtgtggcctctatgaggtgactcagacaccgtcagtgtccgtctccccaggacagacagccagcatcagctgttcngganataaaagtggaagataaatatgtttcctggtatcgccagaacgccaggccagtcgcctgtcctggtcatctatcacgataagaacgcggcctgagggactccctgacgcgtattctctcggctcccaattcgagggaaaccacacgcccacttcacgaccatcgacggccgggacccaggctagngangagntgactnttactgcagccgtggacagaacgcacgtcgtgggtcggtcgggacgggaacggccgaggccgttcggcccgttcgtaacggcaaccggcccgaaggccgtccgttccccgtccgg

SEQ ID NO: 314447 - DNA, 610 bp, Homo sapiens
  misc_feature: GZ8MTXP01BJDUO.52.4.A04.1.454.CMB.2.raw
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
tcagcgcagtacgacacgaccggtgctcgatttagagtagtgatcaggggtgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctgganataaatggagataatntgttcnggtancgcagaagccaggccagtcgcctgtcctggtcatctatcacgataagagcggcctgagggactccctgacgcgtatctcgtcgaccctaccaacgttcgaacgggaaccacgaccgacctactctacgactacgacgacgggacccggaccgaggtctaggtaggtagacgggacgtacgttacgtaactttacgttacgttcgtacgaaccggtccgggtaggaacgaacggactaccgtacgtcggttggggtaacggttcggggcggggtaaccggaccgtacgggtcgttacccgggaccggttaccgttcggaccgaaccggttaaccccggcgggttcccttccccggttccccgttccgg

SEQ ID NO: 314448 - DNA, 700 bp, Homo sapiens
  misc_feature: GZ8MTXP01ASWKB.52.4.A04.1.454.CMB.2.raw
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (611)..(611): a, c, t, g, unknown or other
  misc_feature (611)..(611): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctcccaggacagacagccagcatcagtctgttctgganaataaaagtggaagaataaatatgttcngtatcgcaganccagcagtcnctgtctgtcatctatcacgataagaacgccggtcctacgaggtactcccgtagacgtcgtaattcctcgtacggtacccttcccgaaacgttccgtacggggaaacccacgacgaccctacctacgtacgaaccgacgttaccgaacggcccggggaaaccccagggtacccgtaaagttcgggaacgttagggaacgggtcccttaagggggaactttaaaccgggttttacctacggttaccggaacgggtccccggttaggggaaaacccgtaggaaaacggtcctaaccggttccgggttaaggggttccggttccgggggacgggaacgggtaacccgngggttcccggttacgggttacccggttaaccccggtagggtcccgaacgggaccccggttaaacgggcccgttcccggtaaccccccgg

SEQ ID NO: 314449 - DNA, 605 bp, Homo sapiens
  misc_feature: GZ8MTXP01DH8C7.52.4.A04.1.454.CMB.2.raw
  modified_base (156)..(156): a, c, t, g, unknown or other
  misc_feature (156)..(156): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (492)..(492): a, c, t, g, unknown or other
  misc_feature (492)..(492): n is a, c, g, or t
  modified_base (551)..(551): a, c, t, g, unknown or other
  misc_feature (551)..(551): n is a, c, g, or t
  modified_base (595)..(595): a, c, t, g, unknown or other
  misc_feature (595)..(595): n is a, c, g, or t
tcagcgcagtacgacacgaccggtgctcgatttagagtagtgatcaggggctgggcctcaggaagcagcatcggaggtgcctcagccatggcatggactccctctcttcctcggcgtccttgcttactgcacaggatgtgtggcctctatgaggtnactcagacaccgtcagtcgtccgtctccccgaggacagacagccagcatcagtctgttcnggagaataaaagnggaagaattaaatattgttcctggtatcgacagaagccaggccagtccgctgtcctggtcatctatcacgataagaagccggcctacgaggggactcccgtggacgtacgtatttccgtcgtaacgggtaccttccgaaacttccggtaaacggggaaaccaacgacgaccctactacctacgaacccataccgaacggacccgggaacccagggtactagtgggaagtggacgtccgtaggtaacttagtttaacgtgtacnggcccggtagggaaccagaagcctacgtcgtgggtcggttcggggacggcgggaaccgnggacgttcggaaccgttccgaggtccgacggccgaacgggtccnccggtccccg

SEQ ID NO: 314450 - DNA, 545 bp, Homo sapiens
  misc_feature: GZ8MTXP01BHF5S.52.4.A04.1.454.CMB.2.raw
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (440)..(440): a, c, t, g, unknown or other
  misc_feature (440)..(440): n is a, c, g, or t
  modified_base (461)..(461): a, c, t, g, unknown or other
  misc_feature (461)..(461): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccgaggacagacagccagcatcagctgttcngganaataaaagtggaagaataaatatgttccnggtatcgccagaagccaggccagtcgcctgtcctggtcatctatcacgataagaagcggcctacgagggactcccgtagacgtcgattccgtctcgggccttccaaaccgtcgtagggaaccacgacgtccaactctagacctatcgacgccggaacccagggcttagnganggagtctagggacttatacngtcaggccgtggaacaggaancactcgtggtcgttcgggcgggttaggaccgtaggcttcggacccgtctacgggtcacggcccgaagggtccttcccgtccccg

SEQ ID NO: 314451 - DNA, 595 bp, Homo sapiens
  misc_feature: GZ8MTXP01CA0PG.52.4.A04.1.454.CMB.2.raw
  modified_base (213)..(213): a, c, t, g, unknown or other
  misc_feature (213)..(213): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (414)..(414): a, c, t, g, unknown or other
  misc_feature (414)..(414): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtccgtctccccaggacagacagccagcatcagctgttcnggagaataaaagtggaagattaaatnttgttcnggtatcgcagagcagcagtcgctgtcctggtcatctatcacgataagaacgccggccctgacgggactccgagacgcgtattctcgtacggtcctccgaactcgtacgggaaccacgacgacccacgtctacgaccacgtacgacggccgggaacccagggtactagnggatggacggtcttacgggtacgtttaaacttcgtacgtaccgacgggtcccgggtagggaaacccaggtaaaccgctacgttcggtgggttcggttccggggacggacgggacgtcgggccgttacggacccgttcggtaacggccgacggccccgaaggtccccgttccggtcccccgg

SEQ ID NO: 314452 - DNA, 522 bp, Homo sapiens
  misc_feature: GZ8MTXP01AR59D.52.4.A04.1.454.CMB.2.raw
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
  modified_base (321)..(321): a, c, t, g, unknown or other
  misc_feature (321)..(321): n is a, c, g, or t
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctgganataaatggagataatatgttcngtatcgcagagcaggccagtcnctgtctgtcatcatcacgtataagagccggccctgagggactcccgtagacgcgtattcncgtcggcctccaactcgtagggaacncaagccactctagaccctanccgacggccggacccaggacctaggngatgacgtcnggtactagtcgtagtcgacgcggtaggacagtacgctacgtggtcggtcggttcgggacggacggaccgcggttcgttccgaccgtcgtacgcgcgaccgacgtcccgttcccgtcccg

SEQ ID NO: 314453 - DNA, 713 bp, Homo sapiens
  misc_feature: GZ8MTXP01B3SKP.52.4.A04.1.454.CMB.2.raw
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (263)..(263): a, c, t, g, unknown or other
  misc_feature (263)..(263): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctgganaataaatggagataaatntgttcngtatcgcagagccagccagtcnctgcctggtcatctatcacgataagagccggaccctacgaggggactccccgtaggacgacgtatttcctcgtaacgggccttcccgaaactcgtacggggaaacccagtaccgcctaacctctacgaacccagtccgaacgggacccggggaacccagggtaccctaggtacggacgtaggacgggtaccttagggggtaaactttacgtttaaccgtcggtaccggaaacggtcccgggttaaggggaaaccgagggtaaaacgtcccgtaaaccgttcggttcgggggtttaaccgggttccgggggaaaccgggggaacgggaacccccgggtagggttaacccggttccggggttaaaacccccgggttcccgtttaacggggttcccgtaaaacccggggtccccgaaaagggggtccccttccccggggttaaccccccccgg

SEQ ID NO: 314454 - DNA, 655 bp, Homo sapiens
  misc_feature: GZ8MTXP01AI13G.52.4.A04.1.454.CMB.2.raw
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtccgtctcccaggacagacagccagcatcagtctgttcaggaagaataaagtggaagtaattaaatatgtttcctggtactcgacagaacgccgaggcctagtccgtcgtacgtccgtggtacagtctacacgaacgtaataaacggaacgccggtaccctacggacgggtactccgtggacgtcgtacttccgtacgtcggtccctaaccgtaacgtccggtacgggaacctacgacgtccctaactccgtcgaacctacgtccgacggtacccgggaacccgaggtacgtaaggtaggacgttgggaacgtcgtacggttaacgttatttaccggacgtccgtacgggtaccggtacgggacaaacggtacgcgtaccgttcggtggtcgggttacggcgggacggtaccgaagggttcgttaccggaccgttcccgtaggcccgacggcccgttacggcccgttaaccgtcccccggg

SEQ ID NO: 314455 - DNA, 578 bp, Homo sapiens
  misc_feature: GZ8MTXP01EBG67.52.4.A04.1.454.CMB.2.raw
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (350)..(350): a, c, t, g, unknown or other
  misc_feature (350)..(350): n is a, c, g, or t
  modified_base (462)..(462): a, c, t, g, unknown or other
  misc_feature (462)..(462): n is a, c, g, or t
tcagcgcagtacgacacgaccggtgctcgatttagagtagtgatcagggctgggcctcaggaagcagcatcggaggtgcctcagccatggcatggatccctctcttcctcctcgtccttgcttactgcacaggatgtgtggcctcctatgaggtgactcagacaccgtcagtgtccgtctcccaggacagacagccagcatcagctgtctgagataaatggagataaatatgttctggtatcgcagagccaggccagtcgcctgtcctggtcatctatcacgataagaagccggcctcagggatccctgagcgattctctcggntcccactntcgggacacacgcactcntaccgactacagccgggacccgcggaccgttgaggtagtgacggggcttcggaacggttatttaacccgttgtacgaccggtcggttacggggaacacgggaaacggtaccnccgttcgtcggggttcggtttccgggccgggggttaggggacccggtaacgggcgttcggaaccggttcccgtaacgggtcgacgccccggacggtaacccgttccgttcccccgg

SEQ ID NO: 314456 - DNA, 566 bp, Homo sapiens
  misc_feature: GZ8MTXP01DKJ02.52.4.A04.1.454.CMB.2.raw
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgagtgactcagacacgtcagtgtccgtctccccaggacagacagccagcatcagctgttctgagataaaatggagataaatatgttcnggtatcgcagaanccaggccagtcgctgcctgtcatctatcacgataagaacgcggacctgagggactccccgtagacgcgtattcctcgtcggcttcccaaatcgtacggggaaacacgacggcccaaactctacgaccagcgacgccgggtaaccccagggtccttaaaggacggagtacggacgtacgtacgggtaacttaacgttacgtacgtacgacgtcggtaacggaacacgtaacgtcgtacgtcgtaagggtcggttacgggacggacggacgtcgcgttcgaccgtcgtagaaccgaccgcgacgtccgttccgtcccg

SEQ ID NO: 314457 - DNA, 586 bp, Homo sapiens
  misc_feature: GZ8MTXP01EQ86A.52.4.A04.1.454.CMB.2.raw
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (319)..(319): a, c, t, g, unknown or other
  misc_feature (319)..(319): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtcccgtctccccgaggaccagacagccagcatcagctgtcnganataaangagataantgttcngancgcagancagcngtcgctgtcctgtcatctatcacgataagacgccggacctagaggactccgtgacgtcgtacttcncgtaacggcctccgaaactcgacgggaaccacgacgccaacttcgacgaccagcgacggaccgggaacccaggtctagtgggactgtacggcttaggggtaacttagttaccgtgacgcgaccggttggaaaccacgggtaacaccgtcgtcggtcgggttcgggttacgggacggggacggtaccgtagggttccgttaccggttacccggttaacgtaccgggccaacccgggtacccggttacggtcccgttccccggtccccg

SEQ ID NO: 314458 - DNA, 608 bp, Homo sapiens
  misc_feature: GZ8MTXP01B3TGE.52.4.A04.1.454.CMB.2.raw
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (505)..(505): a, c, t, g, unknown or other
  misc_feature (505)..(505): n is a, c, g, or t
  modified_base (522)..(522): a, c, t, g, unknown or other
  misc_feature (522)..(522): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtccgtctcccaggacagacagccagcatcagctgtcagganataaagtggagtataatntgttcngtatcgacagacncagccagtcnctgtcctgtcatctatcagataagagcggtcctagagggtactccgtggacgtcgtattccgtcgtcggaccctaacccgaactcggtaacggggaaaccacgaccggtaccctaacttccgtacgaaacccctagtaccgaaccggggacccgggaaaccccgtaggggtaccttaaggtcgggaagtcggaagggtccttagggtaactttagttacgtcgtacgacggtccggaggaacnggaacgctacgttcggngggttcggttacggggcggttacgggaccagggcttacggacccgttaaggtcgtccgaccggccgacgtcccgttcccgtccccg

SEQ ID NO: 314459 - DNA, 670 bp, Homo sapiens
  misc_feature: GZ8MTXP01A2WND.52.4.A04.1.454.CMB.2.raw
  modified_base (169)..(169): a, c, t, g, unknown or other
  misc_feature (169)..(169): n is a, c, g, or t
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
  modified_base (589)..(589): a, c, t, g, unknown or other
  misc_feature (589)..(589): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtnagtcgtccgtctccccgaggacagacagccagcatcagtctgttctaggaataataaaagngggaagtaattaaatagttcgtttaccgnggtactcgaccaagaacgccgaggcctagtccgcctgtccctggtactagttctatacaacgtaagtaaacgacggccggtaccctaggaacgggcttacccgtggaccgcgtacttccgtctacgggaccctaacctaaacgtcggtaacgggaaacactacgacctactcgacgactacgaccgacgggcccggaaacccgtaggtacttaggacggagtacggacgtccgtaggtaacttagttaccgtcggtacgacggtccggtagggaacctaggacgtactccggttggttgggttcgggcggaacgggttacggggtaaccncgggttccgttccggttaacccggttccgtaacgggtccaacccgggccggaaccggtcccgttccccgttaacccccggg

SEQ ID NO: 314460 - DNA, 537 bp, Homo sapiens
  misc_feature: GZ8MTXP01CIKCJ.52.4.A04.1.454.CMB.2.raw
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (283)..(283): a, c, t, g, unknown or other
  misc_feature (283)..(283): n is a, c, g, or t
  modified_base (369)..(369): a, c, t, g, unknown or other
  misc_feature (369)..(369): n is a, c, g, or t
  modified_base (450)..(450): a, c, t, g, unknown or other
  misc_feature (450)..(450): n is a, c, g, or t
  modified_base (463)..(463): a, c, t, g, unknown or other
  misc_feature (463)..(463): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtgtccgtctccccaggaccagacagccagcatcagctgttcnganataaatggagaataaatatgttctggtatcgcagacgcaggccagtcgctgtcctggtcagtctaancaacgtataaggaacgccggtccctcgaacgggactcccgtaggacgtcgtattcctcgtacgtcctcctaactcgtacgggaacncgtacgcctacgtctagacctacgcgacggcggaacccagggtctaagtggaatggagcctgggaacttactacgtgtacncggcgtgaacganacgctactgtaaggtcgttcggacggagcgtgcgttcgccgtcaggtcacgccacgtccgttccggtaaccccg

SEQ ID NO: 314461 - DNA, 597 bp, Homo sapiens
  misc_feature: GZ8MTXP01CAFGA.52.4.A04.1.454.CMB.2.raw
  modified_base (159)..(159): a, c, t, g, unknown or other
  misc_feature (159)..(159): n is a, c, g, or t
  modified_base (449)..(449): a, c, t, g, unknown or other
  misc_feature (449)..(449): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactnagacaccgtcagtcgtccgtctcccaggacagacagccagcatcagtctgttctaggaagaataaaagtggaaggtaataaaatattcgtttcctggtatccgaccaagaacgccgaggcctagtccgcttgtccctggtcatctatcacgtataaagacgcggaccctgagggtctccgtgagcgtattcctcgtagcctccaatcgtacgggaacacacgccactcacgactacgcgacggaccggacccagtctagcggatggacgctaggtacttagtactggacncggccggtagggacaggaacgtcgtaaccgttcggtgggtcgggttaccggggcgggaaacgggtcccgtaagggttcccgttacggttaccccgttcggtaaccggttcgaccggacccggaacggtccccgttcccgttcccccgg

SEQ ID NO: 314462 - DNA, 641 bp, Homo sapiens
  misc_feature: GZ8MTXP01D9JLA.52.4.A04.1.454.CMB.2.raw
  modified_base (440)..(440): a, c, t, g, unknown or other
  misc_feature (440)..(440): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagaccaccgtcagtcgtccgtctcccgaggacagacagccagcatcagctgttctaggaagtaataaaagtgggaagtaattaaatatgtttcctggtatcgaccagaacgccaggccagtcgctgtcctggtcagttctatcacgataaagacgccggccctgagggactcccgtgacgacgtatttcctccgtcgggccttaacccgaacgtccgtaacggggaaaccacgacgcctactctacgaaccagtcgacggaccggaacccagggccttagnggaatggaggtcctagggtaacctttagttaacgtgtaccgaacggtccggtagggaaacctaggaaacgtctaaccgttcggtaagggttcggttacgggggcccggttaagggaacccgtgggttaccgttcggttaacccggtaaccgtttaaggccgaaccgggccgttaaacgggtcccgttcccgtccccccggg

SEQ ID NO: 314463 - DNA, 679 bp, Homo sapiens
  misc_feature: GZ8MTXP01EPUVT.52.4.A04.1.454.CMB.2.raw
  modified_base (247)..(247): a, c, t, g, unknown or other
  misc_feature (247)..(247): n is a, c, g, or t
tcagcgcagtacgacacgaccggtgctcgatttagagtagtgatcaggggctgggcctcaggaagcagcatcggaggtgcctcagccatggcatggatccctctcttcctcctcgtccttgcttactgcacaggatgtgtggcctctatgaggtgactcagaccaccgtcagtcgtccgtcctccccgaggacagacagccagcatcagctgttcgtaggaagaataaaagtggaagtaattaaatnttgttctaggtatcgacagacgccgagccagtccgctgtcctgtcattctatacgacgtaagtaaacggaacgccggcccctaggacgggtacctcccgtagacgtcgtacttccgtcgtcggacccttccgaaacgttcggacgggaaaccacgacgccctaacttccacgaccctagaccgacggggacccgggaacccagggtactagggacggacgtcggtaacgggtccttaaggttaaccgtttacgttacggtcgttaccgggaccggtaacccgggtaggaacgtaacggaacggtccttacgggttccgggttggggttacgggttccgggggacggttaaccggggaccacgggttccgttcgggttacccgttaacggtccggaaccgacggcccgaacggtcccttccccggtaaccccg

SEQ ID NO: 314464 - DNA, 682 bp, Homo sapiens
  misc_feature: GZ8MTXP01ACKK5.52.4.A04.1.454.CMB.2.raw
  modified_base (170)..(170): a, c, t, g, unknown or other
  misc_feature (170)..(170): n is a, c, g, or t
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
  modified_base (293)..(293): a, c, t, g, unknown or other
  misc_feature (293)..(293): n is a, c, g, or t
  modified_base (422)..(422): a, c, t, g, unknown or other
  misc_feature (422)..(422): n is a, c, g, or t
  modified_base (601)..(601): a, c, t, g, unknown or other
  misc_feature (601)..(601): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtnagtgtccgtctccccaggacagacagccagcatcagtctgttctgganaataaaagtggaagtaataaatntgtttcctggtatcgccagacgccaggccagtccgctgtcctggtcatctancacgataagacgccggccctacgaggactcccgtagacggtcgtactttccgtcgtacgggacccttcccaaacgttccggtaacggggaaacctaccgacggaccctaaacttcctacggaaccctanaccggacggcccggggaaccccagggtaccttacggtagggtactagggacgggtacctaggggtaaactttagtttaccggtcggttaccgacgggtcccgggttagggaaccctaggtaacgaccgtacgtccgggttgggtaccgggttccggggacgggttaacggggtaacccnggggttcccgttacggttaccccggttaacgtacggtcccgaacggcccgttaacgggtcccgttaacccggtccccccgg

SEQ ID NO: 314465 - DNA, 604 bp, Homo sapiens
  misc_feature: GZ8MTXP01CGHQ6.52.4.A04.1.454.CMB.2.raw
  modified_base (227)..(227): a, c, t, g, unknown or other
  misc_feature (227)..(227): n is a, c, g, or t
  modified_base (412)..(412): a, c, t, g, unknown or other
  misc_feature (412)..(412): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtgcctctatgaggtgactcagacaccgtcagtcgtccgtctccccgaggacagacacgccagcatcagtctgttcaggagaataaagnggaagtaattaaatattcgttctggtactcgacagacgccgaggccagtccgctgtccgtggtctatcatacagataaggacgccggcctagacggctccgtagacgcgtacgttctcgtcgaccttaacgactcgtacgggaacacgctaccacgttcacgacatccggacggtccggaaccgngggtactaggtgaggttcggacggtactaggggttaacttacgttaacgtcggagtaccggtcgggtagaaaccgagtaacgccttacggtacgtgggttacggttcggggacgggacggtccggtagttccgttccggttacccggttcgacggaacccgtacgcccgggacgttcccgaacccgtccccg

SEQ ID NO: 314466 - DNA, 600 bp, Homo sapiens
  misc_feature: GZ8MTXP01AW79I.52.4.A04.1.454.CMB.2.raw
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (420)..(420): a, c, t, g, unknown or other
  misc_feature (420)..(420): n is a, c, g, or t
tcagcgcagtacgacacgaccggtgctcgatttagagtagtgatcaggggtgggcctcaggaagcagcatcggaggtgcctcagccatggcatggatccctctcttcctcggcgtccttgcttactgcacaggatgtgtggcctctatgaggtgactcagacaccgtcagtcgtccgtctccccaggacagacagccagcatcagctgttcaggagataaagtggaagataatntgtttcnggtatcgacagacncaggcagtcnctgtcctgttactctancacgaatacgacgtccggacctagaggtactccgtagacgccgtacttctacgtcggacctacccgtaacgtcgacgggaaacctaccgacgaccctagtaccttacgaaccctagtaccgacgggaccgggaacccngggtacctaggttaggatacgggacgtacctagaccgtttaattacgtggttaaccgacggcggtaagaccgtaaggaacgctacgtcggttcgggtcgtcggggacggttagggaccagggttcgcgttaccgttcgttaacgtcgaccgaacgacgtcgccgtcccgttcggtaaccc

SEQ ID NO: 314467 - DNA, 646 bp, Homo sapiens
  misc_feature: GZ8MTXP01BCH3N.52.4.A04.1.454.CMB.2.raw
  modified_base (359)..(359): a, c, t, g, unknown or other
  misc_feature (359)..(359): n is a, c, g, or t
  modified_base (453)..(453): a, c, t, g, unknown or other
  misc_feature (453)..(453): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtccgtctccccgaggacagacagccagcatcagtcttgttctaggaagtaataaaagtgggaagtaaattaaaagtgttcgtttcctaggtactcgaccaagaacgccgaaggccagtccgctgtcctgtcatctatcgacgataacgacgcgaccctagaggtctccgtagacgtctatttccncgtcgtaccctcgaaacgttcggacgggaacctacgacgtccctaactcctagaacccttacgcgaacgggccggaacccgaggtaccttaggnggacgttgggaacgtccgttaagggtaccttaagtttccgtcggtacgaaccgggtccggttaacggggaaacaaggtaccgtcctacgtttccgggtggggttccggttacggggcggttacgggaaccgtggccgttacgacccggtaagtcgggcaaccggtcccgagggtcccgttcccggtaaccccg

SEQ ID NO: 314468 - DNA, 613 bp, Homo sapiens
  misc_feature: GZ8MTXP01EA4JJ.52.4.A04.1.454.CMB.2.raw
  modified_base (154)..(154): a, c, t, g, unknown or other
  misc_feature (154)..(154): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtgcctctatgaggtnactcagaccaccgtcagtcgtccgtccaccccgaggacagacacgccagcatcagcttgtcaggaagaataaagtggaagtaattaaatattgttccgtggtactcgcaagacgccgaggccagtcgcctgtctgtcatctatacacgataagacgccggacctcgacgggtactccgtagaccgtacgtattccgtacgtcggcctaaccaacgttcggacggaacctacacgcctaactcgagacccagacgacgggacccggaaacctgggacttagcggaatggagtccctagggtaactttgttactgtaccgacggccggttgggaaaccaggtaactcgtacgtccgggtaaggttcgggttcgggacgggacggaaccgtgggttaccgttcgttacccggtcgttacggcgtacccggaccgttacggggtcccttcccggttcccccgg

SEQ ID NO: 314469 - DNA, 655 bp, Homo sapiens
  misc_feature: GZ8MTXP01EGMKN.52.4.A04.1.454.CMB.2.raw
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtccgtctcccaggacagacagccagcatcagtctgtcnganaataaagngagataaatntgttcnggtatcgacaagacnccgagcagtcgctgtcctgtcatctatcgagataagacgccgcctagaggtacctccgtagacgtcgtactttctacgtcggtaccctaaccgtaaacgttcggaacgggaaacaccgaacgcctaaacgttcgacaacctacgcgaaacggcccgggttaaacccgaggtactaggacggagtacggacgttctaacgggttaacttacgttaccgtacggaccggtaacgggtccggaacggtaacacggtaacgtccgttacgttggttaacgggttccggggttacggggacggttaacccgggacgtacgggttccggttaccggttacccgggttaacgtaccgggtaacccgaacccggtaccgttaccgggttcccgttcccggtaacccccg

SEQ ID NO: 314470 - DNA, 599 bp, Homo sapiens
  misc_feature: GZ8MTXP01BYEAE.52.4.A04.1.454.CMB.2.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (420)..(420): a, c, t, g, unknown or other
  misc_feature (420)..(420): n is a, c, g, or t
tcagcgcagtacgacacgaccggtgctcgatttagagtagtgatcaggggtgggcctcaggaagcagcatcggaggtgcctcagccatggcatggatccctctcttcctcggcgtccttgcttactgcacaggatgtgtggcctcctatgaggtgactcagacaccgtcagtgtccgtctcccccaggacagacagccancatcagctgttctgganataaaatggagataaatntgtttcnggtatcgccagancagccagtcgctgtcctggtcatctatcacgataagaagccggcctcgagggctcccgtgaccgcgtatccgtctggctcccaacgttcaggggaaccaccgtagccgaacttcgtacgacccagtccgacgccgggaccccgagggacctagttgggattaggnggtacgtacgtacgttattaacgttgtaccgtacgacccggttcgggaccgaaggtaacgacgtaaccggttcggtcgggttgggttcccggggcggggtaacgggttccggacggtcgttaccggttccgttccgtaacgtcgaaccgtcccgacggttaccgccgttccccgttccg

SEQ ID NO: 314471 - DNA, 490 bp, Homo sapiens
  misc_feature: GZ8MTXP02HRU21.52.4.A04.1.454.CMB.2.raw
  modified_base (243)..(243): a, c, t, g, unknown or other
  misc_feature (243)..(243): n is a, c, g, or t
  modified_base (306)..(306): a, c, t, g, unknown or other
  misc_feature (306)..(306): n is a, c, g, or t
  modified_base (405)..(405): a, c, t, g, unknown or other
  misc_feature (405)..(405): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgttccnggtatcgccagaagccaggccagtcgcctgtcctggtcatctatcacgataagaagcggcctnagggatccctgagcgattctctggctccgaactctagggaaccacagccactctgacccatcagcgggacccaggctagtgatgaggctgactattacngtcagccgtgggacagaagcactcgtggtgttcggcggaggaccagggctcgaccgtccgtaggcacgccaaggcctcgcccccg

SEQ ID NO: 314472 - DNA, 533 bp, Homo sapiens
  misc_feature: GZ8MTXP02F2NOG.52.4.A04.1.454.CMB.2.raw
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
  modified_base (300)..(300): a, c, t, g, unknown or other
  misc_feature (300)..(300): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (383)..(383): a, c, t, g, unknown or other
  misc_feature (383)..(383): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgtctgganataaatggagataatatgttcnggtatcgcagaagccaggccagtcgcctgtcctggtcatctatcacgataagagcggccctnagggactcctgacgcgattctctggcctccaatctagggaaccacacgccactcngacccancgacgccggaccaggactagngagtgacgctagtacttagtcgtagtacgacggtcggaggaacagacgactacgtcggtcggttcggtacggggacgggacgggaccgacggtccgtacggtacccgtaacgtacggtaccgaccggacccgacggtcctcccggccccg

SEQ ID NO: 314473 - DNA, 539 bp, Homo sapiens
  misc_feature: GZ8MTXP02I8N0K.52.4.A04.1.454.CMB.2.raw
  modified_base (388)..(388): a, c, t, g, unknown or other
  misc_feature (388)..(388): n is a, c, g, or t
tcagcgcagtacgacacgaccggtgctcgatttagagtagtgatcaggggctgggcctcaggaagcagcatcggaggtgcctcagccatggcatggatccctctcttcctcctcgtccttgcttactgcacaggatgtgtggcctcctatgaggtgactcagacaccgtcagtgtccgtctccccaggacagacagccagcatcagctgttctggagataaatggagataaatatgttctgtatcgccagaagccagccagtcgcctgtcctggtcatctatcacgataagagccggcctgaggactcctgagcgtattctctaggcctccgaaactcgtagggaaccacagccaactcgtgaacccatcgacggacccgggaacccncggacttagagggactcggaaaggcttaggaacttattactggacaacggccgtgggaacagaacgcaccgtgtgggtgtaccggcgggacggactacgggctcggacccgttcgaggtaccgacggacccgaaggtccgcgtacccccgg

SEQ ID NO: 314474 - DNA, 497 bp, Homo sapiens
  misc_feature: GZ8MTXP02FHDKQ.52.4.A04.1.454.CMB.2.raw
  modified_base (357)..(357): a, c, t, g, unknown or other
  misc_feature (357)..(357): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggagataaatatgttctggtatcgcagaagccaggccagtcgcctgtcctggtcatctatcacgataagaagcggccctcagggactccagagcgattctctggctccaaactctagggaacacagccactcngaccatcaggccggaccaggctagngangagnagtactattactgtcgacgtcggaggacgagacgctacgtcgtcggtcggtcgggcggacggacgcgcgtcgaccgtcgtacgacgacggaccgacggcctccgcccg

SEQ ID NO: 314475 - DNA, 492 bp, Homo sapiens
  misc_feature: GZ8MTXP02JT1GA.52.4.A04.1.454.CMB.2.raw
  modified_base (239)..(239): a, c, t, g, unknown or other
  misc_feature (239)..(239): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
  modified_base (340)..(340): a, c, t, g, unknown or other
  misc_feature (340)..(340): n is a, c, g, or t
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctcccaggacagacagccagcatcagctgtctggagataaatggagataaatatgttccnggtatcgccagaagccaggccagtcgcctgtcctggtcatcatcacgataagagcgcctgaggactccngagcgattcngtggctccaatcgtacggaacncgacgccactctgaccatcagcggaccnggctagtgatgagctgactatacngtacagccgtaggacagaagctactcgtggtcgttacgggcggacggaccgaggcctacggaccgtcgtacggtcacggccgaacggtccacgtcccccg

SEQ ID NO: 314476 - DNA, 530 bp, Homo sapiens
  misc_feature: GZ8MTXP02I6HW1.52.4.A04.1.454.CMB.2.raw
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (350)..(350): a, c, t, g, unknown or other
  misc_feature (350)..(350): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctgganataaatggagataaatntgttctggtancgcaganccaggccagtcnctgtcctggtcatctatcacgataagacgccgccctgaggctcctgagcgtattctctcggccttccgaacttcgtagggaaaccncgtacgccactctagacccatcgacgcccgggacccaggctagtggactggagtctagacttagtactgtacacggtccggtaggacaggacgactacgtcggtggtcggtcggacgggtaggaccgtcggacgtcgacccggtcgtacggcaccggtacccgacgggtcctccgccccg

SEQ ID NO: 314477 - DNA, 641 bp, Homo sapiens
  misc_feature: GZ8MTXP02F5Z70.52.4.A04.1.454.CMB.2.raw
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggagataaatatgttcctggtatcgccagaagccaggccagtcgcctgtcctggtcatctatcacgataagacgcggccctgagggactcccgtgagcgattctctggcctccgaactcgtacggggaaaccacgacgccctaactctacgacccagtcgacgccggggaaccccagggcctagtggatggaaggtcctaggtaaccttagttacctaggttaccgaacggtcccggttaggggaaccaaggaaacgtccgtaacgttcggttacgggggttcggtttaccgggggaccggggtaacggggacccgacggggtacccgttacgggtaaacccccgggttccgttaacggggtacccgtaaccgggtacccccgaaaacgggggtccccttaccggtaccccccccgg

SEQ ID NO: 314478 - DNA, 513 bp, Homo sapiens
  misc_feature: GZ8MTXP02GCH9W.52.4.A04.1.454.CMB.2.raw
  modified_base (212)..(212): a, c, t, g, unknown or other
  misc_feature (212)..(212): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (303)..(303): a, c, t, g, unknown or other
  misc_feature (303)..(303): n is a, c, g, or t
tcagcgcagtacgacacgaccggtgctcgatttagagtagtgatcaggggtgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttcnggagataaaatggagataaatntgttccnggtatcgcagaagccaggccagtcgctgtcctggtcatctatcacgataagaagcggccctnagggatccctgacgcgattctctggccttcactctagggaaaccacgagccactctagaccatcacgcggacccaggctagtggatgagctgactatactgtcagccgtgggacaggaagcacgtcgtggtcgttcgggcggtacgggaccgaggcgtacgaccgtaccgtaagggtccaacggacccgaaggcctccgcccccgttcgg

SEQ ID NO: 314479 - DNA, 558 bp, Homo sapiens
  misc_feature: GZ8MTXP02HO8XG.52.4.A04.1.454.CMB.2.raw
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (321)..(321): a, c, t, g, unknown or other
  misc_feature (321)..(321): n is a, c, g, or t
  modified_base (348)..(348): a, c, t, g, unknown or other
  misc_feature (348)..(348): n is a, c, g, or t
  modified_base (452)..(452): a, c, t, g, unknown or other
  misc_feature (452)..(452): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctcccaggacagacagccagcatcagctgttctgganataaatggagataaatntgttcnggtatcgcagaagcaggccagtcgcctgtcctggtcatctatcaacgataagagcggcctgagggctccctgagcgatttcncgtggctccaaactctagggaaaccanacgcccactctagaacccatccgaggccggggacccagggtcctaagtgggattcggagggctaggaacttagttactcggtacacgccggtaggacagaacgntacgtcgtgggtcggttcgggacgggtagggaccgagggtccgttcggaaccccgttcgtaacggggtccacggacccccggaaggtcccgttacggtccccccgg

SEQ ID NO: 314480 - DNA, 519 bp, Homo sapiens
  misc_feature: GZ8MTXP02JPVIP.52.4.A04.1.454.CMB.2.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (323)..(323): a, c, t, g, unknown or other
  misc_feature (323)..(323): n is a, c, g, or t
  modified_base (409)..(409): a, c, t, g, unknown or other
  misc_feature (409)..(409): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgtctgganataaatggagataatatgttccnggtatcgcagaagccaggccagtcgcctgtcctggtcatctatcacgataagaagcggccctgagggactccctgagcgattcnctggcctccaactcgtagggaaccacagccactctcgacccatcgagccgggacccaggctagtggatggagctagacttattacngtacagccggtagggaccagaacgctacgtcgtgggtgttccggggcggacgggaccaggccgtggacccgtcgtacgggtccacggccccgaaggccgtcgtcccccgg

SEQ ID NO: 314481 - DNA, 723 bp, Homo sapiens
  misc_feature: GZ8MTXP02HUUBT.52.4.A04.1.454.CMB.2.raw
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccaccgtcagtgtccgtctccccaggacagacagccagcatcagctgttcngganataaatggagataatntgttcngatcgcagancaggccagtcnctgtcctggtcatctatcaacgataagacgcggccctagacggactcccgtgacgtccgtatttcctctcgggcctccgtaaacgtcgtagggaaaccacgacgccctaactcgtacaaaccctagtacccgacgggacccggggaaacccctggggtaccttaaggtcgggaaagtcgggaacgggtcccttaaggtaacccttttaaagttcccgttagggttaccccaaggggccccgggttagggggaaacctaaaggggaaccgttaccaacccggtttcccggtttagggggtttaccggggtttcccgggggaaaccggggtaacgggggtaaacccccgggtacgggggttacccggttacccggggtaccccggtttaaccggttaccggggtaccccgtaaacccggaccccgggtaaaccggttccccggtttacccccggtaccccccgg

SEQ ID NO: 314482 - DNA, 511 bp, Homo sapiens
  misc_feature: GZ8MTXP02HFIOM.52.4.A04.1.454.CMB.2.raw
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (423)..(423): a, c, t, g, unknown or other
  misc_feature (423)..(423): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctgganaataaaatggaagataaatatgttccnggtatcgccagaagccaggccagtcgcctgtcctggtcatctatcaacgataaagaagcggccctgagggactccctgagcgattctctggctccaaactctagggaacacagccactcngaccancgagcgaccagctagngangagctagactatactgacagcggtaggacagacncgacgtcgtggtcggtcgggacggacgggaccgacggccgtaccggaccgtcgtacggaccgacgacccgacggcccgtccggccccg

SEQ ID NO: 314483 - DNA, 545 bp, Homo sapiens
  misc_feature: GZ8MTXP02H5XZX.52.4.A04.1.454.CMB.2.raw
  modified_base (169)..(169): a, c, t, g, unknown or other
  misc_feature (169)..(169): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
  modified_base (364)..(364): a, c, t, g, unknown or other
  misc_feature (364)..(364): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtnagtcgtccgtctcccaggacagacagccagcatcagctgtcngganataaagtggagataatntgttctgtancgcaganccaggcagtcnctgcctgtcatcatcagataagagcgcctgaggactccgtgacgcgtattctcgtggcctccaaacgttcgacgggaaaccacacgcccactacctcgaaccanaccgacggcccggacccgaggcgttaagacggtagtagaggtctaggtaccttaagttacgtcggtacaggtaccggtaggggaccaaggaacgctaacgtcgtgggtacgttcggggacggacgggaccgacggcgtacggacccgtccgtaggacacgccgaacgccgtaccgccccgg

SEQ ID NO: 314484 - DNA, 494 bp, Homo sapiens
  misc_feature: GZ8MTXP02HOMP7.52.4.A04.1.454.CMB.2.raw
  modified_base (238)..(238): a, c, t, g, unknown or other
  misc_feature (238)..(238): n is a, c, g, or t
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
tcagcgcagtacgacacgaccggtgctcgatttagagtagtgatcagggtgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaatggagataaatatgttcnggtatcgcagagccaggccagtcgctgtcctggtcatctatcacgataagagcggcctnagggatcctgacgcgattctctggcctcactctggaacncagccactctgaccatcacgcgggacccaggctagtcgatgagctgactattactgtaccagccgtagggacagagcactcgtggtcgttcggcggaaggccaggccgtcgacccggttctaagggcaacggcccgaaggtcctcggcccccgtccgg

SEQ ID NO: 314485 - DNA, 535 bp, Homo sapiens
  misc_feature: GZ8MTXP02JGXP4.52.4.A04.1.454.CMB.2.raw
  modified_base (361)..(361): a, c, t, g, unknown or other
  misc_feature (361)..(361): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgtctggagataaatggagataatatgttctggtatcgcagagccaggccagtcgcctgtcctggtcatctatcacgataagaagcggcctcagggactcctgagcgattctctggctccaactctaggggaacacacgccactctgacccaanacgacgccggaccacggactagagagtagacggtctagtactacttacgtcgtacgacggtaccggtacgggaacgaacgacgacgtacgtcgtcggtcggtcgggacggacgggacgacggtccgtacggaccgtaacgtacggtacgacgaccgacggtccgtaccgtcccg

SEQ ID NO: 314486 - DNA, 479 bp, Homo sapiens
  misc_feature: GZ8MTXP02F3A98.52.4.A04.1.454.CMB.2.raw
  modified_base (241)..(241): a, c, t, g, unknown or other
  misc_feature (241)..(241): n is a, c, g, or t
  modified_base (416)..(416): a, c, t, g, unknown or other
  misc_feature (416)..(416): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctcccaggacagacagccagcatcagctgttctggagataaaatggagataaatatgttccnggtatcgccagaagccaggccagtcgcctgtcctggtcatctatcacgataagaagcggccctcagggatccctgagcgattctctggctccaatctgggaacacagccactctgaccatcagcggacccaggcatggatgaggctgactatactgtcagccgtgggacaggaancactctggtgttcggcggagggaccaggctggaccgtcgaggtcagcccaaggctcgcccccg

SEQ ID NO: 314487 - DNA, 655 bp, Homo sapiens
  misc_feature: GZ8MTXP02IGYK8.52.4.A04.1.454.CMB.2.raw
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
tcagcgcagtacgacacgaccggtgctcgatttagagtagtgatcaggggctgggcctcaggaagcagcatcggaggtgcctcagccatggcatggatcccctctcttcctcggcgtccttgcttactgcacaggatgtgtggcctctatgaggtgactcagacaccgtcagtgtccgtctccccaggacagacagccagcatcagctgttcngganataaatggagataatatgttcngtancgcagagcagccagtcnctgtctgtcatctatcaacgataaagaagcggacctcgacgggatcccgtgacgcgtattctctcggcctccaactcgtacgggaaacccacacggcctaacctctacggacccaagtccgaacgggacccggggtaaccccgaggggtacctttaaggtacggggacgttacgggaaagggtcctttaacggtaaaccttttaaaggtttaacccgtttaggtccgaaccggggtcccggttaagggggaacccgtaaacggggaacgtaccgtacgttcggttacgggttcgggttaccggggacgggtaaccgggaccgtacgggtaccgtaccggtacccggttaacggtaacggaccgaccggacccgtacggtccgtacccgtaccccg

SEQ ID NO: 314488 - DNA, 545 bp, Homo sapiens
  misc_feature: GZ8MTXP02JS6V7.52.4.A04.1.454.CMB.2.raw
  modified_base (216)..(216): a, c, t, g, unknown or other
  misc_feature (216)..(216): n is a, c, g, or t
  modified_base (313)..(313): a, c, t, g, unknown or other
  misc_feature (313)..(313): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctcccaggacagacagccagcatcagctgttctgganataaaatggagataaatatgtttcctggtatcgccagaagccaggccagtcgctgtcctggtcatctatcacgataagagcgcctcgaggactccgngacgcgtattctcgtcggcctaccaacttcgacgggaaccacgacgaccactcgtacgaaccactacgacggacccgggacccgaggacctaaggtcggatggacggctaggacttattactcgtacacggcggtacgggacagaacgctacgtcgtacgggtcggtcggcgggacggacgcggtctagacccgtcgtaacgtcgaccgaccgacggcgtaccgtcccccgg

SEQ ID NO: 314489 - DNA, 503 bp, Homo sapiens
  misc_feature: GZ8MTXP02F2A6P.52.4.A04.1.454.CMB.2.raw
  modified_base (326)..(326): a, c, t, g, unknown or other
  misc_feature (326)..(326): n is a, c, g, or t
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaatggagataaatatgttcctggtatcgccagaagccaggccagtcgcctgtcctggtcatctatcacgataagaagcggcccctgaggactccctgagcgattcnctggctccaactcgtagggaacacagccactctagaccatcagcggacccaggctagngatgaggctgactatacngtcagccgtaggacagagcacgtcgtggtcgttcggcggacgggaccgagggactcggacccgtcgtaacggtccacggcccaacggcctacgtcccccgg

SEQ ID NO: 314490 - DNA, 541 bp, Homo sapiens
  misc_feature: GZ8MTXP02G72TF.52.4.A04.1.454.CMB.2.raw
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
  modified_base (333)..(333): a, c, t, g, unknown or other
  misc_feature (333)..(333): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccaggacagacagccagcatcagctgttcngganataaagtggaagataaatatgttcnggtatcgcagagccaggccagtcgcctgtcctggtcatctatcaacgataagaacgcggccctagagggactccgagacgctacttctcncggctcccgaaactcgtacgggaaaccacgacgaccctactcacgaacccatccgaggcccggacccagggcctaagtggatggaacgtctagtactagttactgtacgacgtccggagggacacgaacgcactcggtggttcggtacggacggaggaccgaggccgttcgaccgtcgtcggacgacgcccgacggccctcgcccccg

SEQ ID NO: 314491 - DNA, 527 bp, Homo sapiens
  misc_feature: GZ8MTXP02J3QO5.52.4.A04.1.454.CMB.2.raw
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
  modified_base (436)..(436): a, c, t, g, unknown or other
  misc_feature (436)..(436): n is a, c, g, or t
  modified_base (457)..(457): a, c, t, g, unknown or other
  misc_feature (457)..(457): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccaccgtcagtcgtccgtctccccaggacagacagccagcatcagctgttcngganaataaaatggagataaattatgttcctggtancgccagaacgccaggccagtcgcctttgcctggtcatcctatcaacgataaaggaacgccgggcccctgacgggactccctgacgtcgattctctcggcctccgaaactctcggggaaccacacgccactctgacccatcgacggccgggacccaggtctagtggatgaggctagacttattacngtcaggccgtgggacaggacnctactcgtggtgtcgggcggacggacgacgctcgaccgtcgtacgcacgcccgacgtcctcccgtccccg

SEQ ID NO: 314492 - DNA, 622 bp, Homo sapiens
  misc_feature: GZ8MTXP02JBKKZ.52.4.A04.1.454.CMB.2.raw
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
tcagcgcagtacgacacgaccggtgctcgatttagagtagtgatcaggggtgggcctcaggaagcagcatcggaggtgcctcagccatggcatggatccctctcttcctcggcgtccttgcttactgcacaggatgtgtggcctcctatgaggtgactcagacaccgtcagtgtccgtctcccaggacagacagccagcatcagctgttcngganataaagnggagataatntgttcnggtatcgcagaagcaggccagtcgctgtcctgcatctatcagataagacgcggcctgaggactccgtgacgcgattcnctgctaccacgtcgtaggaaacacgacgccaactctacgaccactacgaggaccgggtacccaggtcctaagtgggaactaggaacgggtctacggtaaacttacgttacgtcgttacggacgtacccggtagggaaccgaaggtaacgccgttaaccgtcgttagggggttcggttccgggggaccggggtaacggggtaaacccggtacgggtaccgttaccgggtaccccggttacggtaaccgggacccgtaaccgggtaccccggtaacgggtccccgtaccccgggtaccccgttaccgg

SEQ ID NO: 314493 - DNA, 759 bp, Homo sapiens
  misc_feature: GZ8MTXP02I7Q7K.52.4.A04.1.454.CMB.2.raw
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtcccgtctccccaggaccaggaccgacgccagctactcgacgtcgttgttcgtaggaagtaaataaaggtgggaagtaaattaaatagttcgtttccgtagtacgtccgaccgaagacgaccgacggacctaggtcccgtccgttcgttccgtggtacctacttactactaccgaagtaaagtaaacggacggcccggtcccctaggacggtaccttcccgaggacgtcgtacttcctgtccggtacctaccgtacgtcggtaacggaaccaccgacgtccctacttaccgacgaacccacgtaccggaccgggacccggggtaacccgacggtaccgttacggtacgggacgtagggtaccgggtacttacggtaaaccttttaacgtttaccggtacggttacccgaacgggttcccggggtaagggaaaccgaaagggacctaccgtaaccggttcgggttaggggtccgggttaccgggggaacggggtaaccgggaaccggtcgggtaccggtccggtaacccggttaacggtacggtacgaacccgggacccgttaacggcccgtacccgttcccccgg

SEQ ID NO: 314494 - DNA, 505 bp, Homo sapiens
  misc_feature: GZ8MTXP02FQR18.52.4.A04.1.454.CMB.2.raw
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
  modified_base (436)..(436): a, c, t, g, unknown or other
  misc_feature (436)..(436): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggagataaanatgttcnggtatcgcagaagccaggccagtcgcctgtcctggtcatctatcacgataaagaagccggccctcgagggatccctgagccgattctctggcttccgaactctagggaaaccncaagccaactcngacccatcagccggacccnggctatggatgaggctgactattactgtcagccgtggacagaagcaccgtntaggtgttcggcgggaggaccgaggctggaccgtccgttaggacacggccccaaaggcctcgtcccccg

SEQ ID NO: 314495 - DNA, 545 bp, Homo sapiens
  misc_feature: GZ8MTXP02G3CAJ.52.4.A04.1.454.CMB.2.raw
  modified_base (268)..(268): a, c, t, g, unknown or other
  misc_feature (268)..(268): n is a, c, g, or t
  modified_base (381)..(381): a, c, t, g, unknown or other
  misc_feature (381)..(381): n is a, c, g, or t
  modified_base (405)..(405): a, c, t, g, unknown or other
  misc_feature (405)..(405): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccaggacagacagccagcatcagctgtctggagaataaagtggaagataaatatgttctggtatcgcagacgccaggccagtcncctgtcctggtcatctatcacgataagacgcggaccctgacgggactcccgagacgcgtattctcgtcggctccgaaactcgtacgggaacacgacgccactctcgaacctancgacggcccgggacccaggctagngatgacggctagacgttatactgtacgacgcggtacgggacaggaacgtcaacgtcgtaggtcggttcggggacggacgggaccgacggtcctacggtaccgtccgtaaggccaccggaccgacggcctccgtcccccgg

SEQ ID NO: 314496 - DNA, 497 bp, Homo sapiens
  misc_feature: GZ8MTXP02J2G3G.52.4.A04.1.454.CMB.2.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggagataaatatgttcnggtatcgcaganccaggccagtcgcctgtcctggtcatctatcacgataagaagcggccctgagggatcccgtgacgcgattctctggctccaactctgggaacacagccactctagaccatcaggccggacccaggcctaagtgggactggaggctggactattactgtcgagccggtagggacagaacgcactcgtgggtagttcgggcggaggccgacggctggaccgtcgtagcacgccgaggctcgccccg

SEQ ID NO: 314497 - DNA, 611 bp, Homo sapiens
  misc_feature: GZ8MTXP02IMHVH.52.4.A04.1.454.CMB.2.raw
  modified_base (218)..(218): a, c, t, g, unknown or other
  misc_feature (218)..(218): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccaccgtcagtgtccgtctccccaggacagacagccagcatcagctgttctgganataaatggagataatatgttctggtatcgacagagccaggccagtcgcctgtcctggtcatctatcagataagagcggccctgagggatccctgacgcgtattctctcggcctccgactcgtacggggaaaccacgtacgcctactctcgacccatacgacggaccggacccacggtactagtacggatggacggtctaggaacttacgttacgtgtaccgacggtccggtagggacaaggacgtacgacgttccggttagggtcgggtttaccggggacggggtaaacggggaccggtacggggtaccgttaccggtaacccggttaaccggtacgggttaccgtaaccggtaccccggaaacggttacccggtacccggttaccccccggg

SEQ ID NO: 314498 - DNA, 645 bp, Homo sapiens
  misc_feature: GZ8MTXP02JF0K4.52.4.A04.1.454.CMB.2.raw
  modified_base (212)..(212): a, c, t, g, unknown or other
  misc_feature (212)..(212): n is a, c, g, or t
  modified_base (314)..(314): a, c, t, g, unknown or other
  misc_feature (314)..(314): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctcccaggacagacagccagcatcagctgttcnggagataaatggagataatatgttctggtatcgcagaagccaggccagtcgcctgtccctggtcatctatcacgataagagccggccctgacggactcccgngacgcgtattcgtcgtcggcctccaacgtcggtacggaaccacgacgacctactcgtacgaaccctacgtaccgacgggacccgggacccacgggtacgttaacggtacgggacgtacggacggtcgtacgtaacgtttacgttacgtcggtaccgaccgggtccggtacgggaacgaacggaacgtaccgtacgttcggtcggggttacgggtaccggggacggggtaaccggggaaccgtacgggtacccgtaccgggtaaccccggttaaccggtaaccggtaaccgacccggtaccccggaacggtccccgtacccccggtcccccg

SEQ ID NO: 314499 - DNA, 548 bp, Homo sapiens
  misc_feature: GZ8MTXP02HDA5Q.52.4.A04.1.454.CMB.2.raw
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctgganataaatggagataatatgttcnggtatcgccagaagccaggccagtcgcctgtcctggtcatctatcaacgataagaagcggccctagaggactccgngacgcgattcncgtggcctcctaaactcgtacggggaaaccaccgaagccctaactcctagacccatccgaggcccgggacccagggctaagtggatgaggcctagacttatacgtgtacgacgcgtgggaacaggaagcaacgtcgtggtcgttacggggcggtacggaccgagggtcctcggtacccgtcgttacggaccgacggacccgaacggtcctcccggtcccccg

SEQ ID NO: 314500 - DNA, 543 bp, Homo sapiens
  misc_feature: GZ8MTXP02FUYQ8.52.4.A04.1.454.CMB.2.raw
  modified_base (280)..(280): a, c, t, g, unknown or other
  misc_feature (280)..(280): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (405)..(405): a, c, t, g, unknown or other
  misc_feature (405)..(405): n is a, c, g, or t
  modified_base (460)..(460): a, c, t, g, unknown or other
  misc_feature (460)..(460): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctaggaagaataaaagtggaagtaattaaatattgtttcctggtatcgaccagaacgccaggccagtcncctgtcctggtcatctatcgacgataagacgcggaccctagagggtactccgtgacgtcgattcnctcggcctccaactcgtaggaaccncacgccactctagacccatcgaacggccggacccngactagtgatggacggctagactagtacttgacgacggtccgagggacaggaacnctacgtgtcggtcggtcgggacgggacgacgcggtctaccggtaccgtcgtcggacgaccgaccgtacggccgtcccgtcccg

SEQ ID NO: 314501 - DNA, 652 bp, Homo sapiens
  misc_feature: GZ8MTXP02G2WJG.52.4.A04.1.454.CMB.2.raw
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (395)..(395): a, c, t, g, unknown or other
  misc_feature (395)..(395): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccaccgtcagtcgtccgtctccccgaggacagacagccagcatcagcttgttctgganaataaagnggaagaataaatattgttctggtatcgcaagacgccaggccagtcgcctgtcctggtcatctatcaacgataagaacgccggccctagagggtactcccgtagacgcgtacttctcgtcggcctccgaaacttcggtacggggaaaccacgacgaccctacttacncgaaccagtaccgacgggacccgggaaccccaagggtccttaacggtacgggattacggggaaacgggtccttaacggtaacctttaagttacgttcggtaccgaacggtccggtaaggggaaccaagggaacgtaccgtacgtaccggttggggtacggttccggggacggggtacgggaacccgtcgggtacctacgggtaacccgttaacgacggtaccgaccggacccgaacgggtccctaccggtcccccgg

SEQ ID NO: 314502 - DNA, 707 bp, Homo sapiens
  misc_feature: GZ8MTXP02IMIL6.52.4.A04.1.454.CMB.2.raw
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (264)..(264): a, c, t, g, unknown or other
  misc_feature (264)..(264): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtcccgtctccccaggacagacagccagcatcagctgttcngganataaatggagaataatatgttctggtatcgcagaagcaggccagcncctgtcctgtcatctatcacgataaagaagcggccctcgagggactcccgtgacgcgaactttccgtctcggccttccgaaacttccgtaacgggggaaaccaccgaacgccctaaactcgtacgaaccctaagtaccgaacggacccggggaacccccgaaggggtacccttaaacggttcgggaacgttagggaaacggggtccttaacgggtaaaccctttaagtttaacccgttggttaaccgaccggggtacccggttaggggaaccgaaaggggtaaaaccgtaccgtacgttaccggttacgggggttacgggttaccgggggaccgggggtaaaccggggacccgtaacggggtaccgttaccggtacccggttaacccggttacgggtaccgtaccggtaacccggaaccgggtcccgtaccccggtacccccg

SEQ ID NO: 314503 - DNA, 550 bp, Homo sapiens
  misc_feature: GZ8MTXP02I548B.52.4.A04.1.454.CMB.2.raw
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccaggacagacagccagcatcagcttgttctggaanaataaagtggaagataaatatgttctggtancgaccagacgccaggccagtccgcctgtcctggtcatctatcacgataagacgccgccctgacggactccctgacgcgtattctctcggcctccactcgtaggaccacgacgccactctagacccatcgacggccgggacccaggtcctagtcgagtggaacggtctagacttatacgtgtacgacggtccggaggacgaagacgctacgtcgtcggtcggtcgggacgggtacggacgtacggacgtcggtaccgtcggtacggtaccgacggacccgacggtccgtaccgtcccccg

SEQ ID NO: 314504 - DNA, 529 bp, Homo sapiens
  misc_feature: GZ8MTXP02JB7EX.52.4.A04.1.454.CMB.2.raw
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgtctgganataaatggagataatatgttcnggtancgcagagccaggccagtcgctgtcctggtcatctatcacgataagagcggccctnagggntccctgacgcgattctctggctccgaacttcgtagggaaccacacgccaactcctagacccatcgacggccgggacccaggtctagtgatggaagctagaccttagtacctgtacacgcggtaggacagaagctacgtcgtggtacgttcgggacggtacgggaccagggcctcggaacccgtccgtacggtacgacggacccgaacggtccgtaccgtcccccgg

SEQ ID NO: 314505 - DNA, 811 bp, Homo sapiens
  misc_feature: GZ8MTXP02GNXOR.52.4.A04.1.454.CMB.2.raw
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (242)..(242): a, c, t, g, unknown or other
  misc_feature (242)..(242): n is a, c, g, or t
  modified_base (325)..(325): a, c, t, g, unknown or other
  misc_feature (325)..(325): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttcngganaataaagtggagaataatatgttcnggtatcgcagacgccagccagtcgctgtcctggtcatctatcgaacgtaataaacggagccggccctagaacgggactcccgngacgcgtacttccgtcgtcggtaccctaccgtaaaccgtcggtaacggggaaaccctaaccgaacgtaccctaacttccgttacggaaacccctagtacccggacgggaccccgggggtaacccccaggggttcctttaaacgggggtacgggtacggttacgggaaccgggttccgtttaaacggttaaaccttttaacggtttaacccggttcgggttaacccggtaaccggggttacccggggttaacggggtaaaccgaaacgggttaaaccgtacccgtttaaccggtttccgggtttaccgggggtttacggggttaacccgggggaaccgggggtaaacccggggtacccggtaaccggggtacccggttaaccccggggttaaaccccgggtttccggttaaaccggggtacccggaaaccccggtaacccccgggtaaccgggttcccccggttaccccccgggtttaaccccccgg

SEQ ID NO: 314506 - DNA, 580 bp, Homo sapiens
  misc_feature: GZ8MTXP02G430I.52.4.A04.1.454.CMB.2.raw
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (311)..(311): a, c, t, g, unknown or other
  misc_feature (311)..(311): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctcccaggacagacagccagcatcagctgtctgganataaatggagataatatgttcnggtatcgcagagccaggccagtcgctgtcctggtcatctatcacgataagacgtcggccctgagggtactcccngacgcgtacttctcgtcggtcctcccgaaacttcgtacggggaaaccacgtacggtaccactccgtacgaaccctatacccgaggcccgggaaccctagggacctaagtaggacgttggaacgggtctacgtaccgttatacgttggtactacggccgtaggaacgaggaagtcctacgtcgtgggtcgttacgggcggtacgggaacctcgggtactcggaccgtccgttacggacgacgtaccggacggtccgttaccgtcccccgg

SEQ ID NO: 314507 - DNA, 626 bp, Homo sapiens
  misc_feature: GZ8MTXP02FIPZY.52.4.A04.1.454.CMB.2.raw
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgtctgganataaatggagataatatgttcngtatcgcagagcaggccagtcnctgtcctgtcatctatcacgataagaagccggccctcgagggactcccgtgacgcgattcctcgtggcctcccaaactcgtagggaaccacacgccaactctacgaccatacgacggcccgggaccccagggtcctaagtcgggagtggaacgggtcctaggtaaccttaactttaacctacgggttaccgaccgggtcccggttaggggaaaccgaacggaaaggaccctaaacgttcccggttaggggttaccgggtttccggggaccgggggacggggtaacccgaacggggtccgtaaccggacccgttaaccggtaggtaccccgacggacccccgaacggcccgtaccggtcccccccgg

SEQ ID NO: 314508 - DNA, 622 bp, Homo sapiens
  misc_feature: GZ8MTXP02G6FLK.52.4.A04.1.454.CMB.2.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtccgtctcccgaggacagacagccagcatcagctgttcagganaataaagtggaagataatntgttcngtatcgcagacgcagccagtcgctgtcctggtcagtctatcagataagacgccgccctagagggtactccgtaggacgtcgtacttcgtcgtcggtacctccgtaacgtcggtacggggaaacccacgacgtaccctaactccgtacgaaccctactaccggacggacccgggaaccgtacgggtactaacggttaggagtacgggtaaacggtcctaaggtaactttacgttacgtacggtaccgtaacggccggtaggggacaaggaccgtactacgttcgtggggtcggttacgggacgggtaccggacgacgggtccgtacggtaccgtaacgtacggaccgacggaacccggtacgtcccgtaccgttcccccgg

SEQ ID NO: 314509 - DNA, 738 bp, Homo sapiens
  misc_feature: GZ8MTXP02JNABY.52.4.A04.1.454.CMB.2.raw
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctcccaggacagacagccagcatcagtctgttctaggaagaataaaagtggaaggtaataaattagttgtttccgtagtactcgaccaagaacgccaggccagtcgcctgtcctggtcatctatcacgtaataagacggccggccctacgaggggtacctcccgtaggactcgtattccgtcgtcggccctaccgaaacgttcggtaacgggaaacccacggaccacctaccgttcctaccggtaaccctagtacccggaacgggacccgggggaaccccctaaagggggtccctttaaacggggacgggtaacgttacgggacggttacgttaacgttaacctttaagttaccggtacggtaccgaccgggtaccggggaacgggtaacgtaaggtaaccgtccgtaccgggttacgggttacgggggttaccgggtaccgggggacggggtaacccggggtacggtaccgggtaccggtacccggttacccggttaaccggtaccgggtaaccgtacccgggtaacccggtaccgggtccccgtccccggtccccg

SEQ ID NO: 314510 - DNA, 533 bp, Homo sapiens
  misc_feature: GZ8MTXP02I09UH.52.4.A04.1.454.CMB.2.raw
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctcccgaggacagacagccagcatcagctgtctganataaatggagataatatgttcngtatcgcagacgcagccagtccgcctgtcctggtcatctatcacgataagagccggccctgacggtactcctgacgcgtattctcgtcggcctccgaaactcgtaacgggaccacgacgcctaactccgacgaccacgacgacggccgggaacccagggactagtagataggacgtcgtagtaccttattaccgtagtacacggccgtaggacgagaacgctacgtcgtaggtgtacggcgggacgacgacgcgtacgaccgtcgtaggtcacgaccgacggccgtaccgtccccg

SEQ ID NO: 314511 - DNA, 679 bp, Homo sapiens
  misc_feature: GZ8MTXP02G6W6T.52.4.A04.1.454.CMB.2.raw
  modified_base (212)..(212): a, c, t, g, unknown or other
  misc_feature (212)..(212): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (453)..(453): a, c, t, g, unknown or other
  misc_feature (453)..(453): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtgtccgtctccccgaggacagacagccagcatcagccgttntgagataaatggaggataatatgttcctggtancgccanaagccaggccagtcgcctgtcctgtcactactatcacgataagaaagtccggcctcgagggactcctgacgacgtattctcgtcggctaccactcgtcgggaaactacagactacctactcgaaccacgtacacgggaccggggaccccaagggtctagtagggtagacgaggggttaaccacgtacttaaaacggtttttnaccgggttaccggtaacgaccccgggggttaagggaaccggaaagggaaaacgggcccttaaacggtcccgtttaggggggttccggtttaacccgggggacgggggaaacggggtaaaccgggccggtacgttaaccgggggaccccgttaaccgtaacggggttcgaaaccgtacccccggggaaaaggttccccggtccccgttaaccccggtcccccggggg

SEQ ID NO: 314512 - DNA, 712 bp, Homo sapiens
  misc_feature: GZ8MTXP02I1T3C.52.4.A04.1.454.CMB.2.raw
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtccgtctcccgaggacagacagccagcatcagtcttgttcaggaataataaagtggaagtaattaaatatgtttccnggttacncgacagacgcgacgccagtccnctgtcgtgtcatctanacgaagaagtaagacgccgtaccgtagacggtactccgtagacgtacgtacttcgtcgtcgtacctaccgtaacgtcggtaacggaaccaccgaccgtaccctacgtaccgtaaccgaacctacgtaccggaaccgggacccggtaaccgcggtaacgttaacgggtacgggtagtacggggaaccggttaccgttaaacgttaaccgtttacttaccgggtacggtaccggtaccggggtaccgggtaacggaaacgaacggtaaccgtacgtacggttcgggtacggggttacgggtacggggaaccgggtaaacgggtacccgtacggggtacccgttaccgggtaacccgttcggtaaacggacccgtaacccggtacccggtaccgggtcccgttaccccggtacccccgg

SEQ ID NO: 314513 - DNA, 609 bp, Homo sapiens
  misc_feature: GZ8MTXP02IC41K.52.4.A04.1.454.CMB.2.raw
  modified_base (217)..(217): a, c, t, g, unknown or other
  misc_feature (217)..(217): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtccgtctcccaggacagacagccagcatcagctgttctagganaataaagtggaaggaataaatatagttcctggtatcgaccagaagccgaggcagtcgctgtcctggtcatctatcacgaataagacgcggcctagagggactcctggacgacgtattcctcgtcggctccgaacttcgacggggaaaccaccgcgacctactcctagaccctacgacgacgggcccgggaaccccgaggtaccgtagtagggatcgggaacggtccgtagtaaccttagttacctgtaccgacggtcggaaggaccgaagtaacgccgtaacgtcgtacgggtagggttccggggacgggacggggaccgacggtaccggtacggtacccgtaacggttaccggaccgacgaaccccggacggtccccgttccgccccccgg

SEQ ID NO: 314514 - DNA, 669 bp, Homo sapiens
  misc_feature: GZ8MTXP02IXAJ4.52.4.A04.1.454.CMB.2.raw
  modified_base (304)..(304): a, c, t, g, unknown or other
  misc_feature (304)..(304): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagcttgttctggagtaataaaagtggaagtaataaatatgtttcctggtactcgaccaagaacgccaaggccagtcgcctgtcctggtcatctatcgaanataagacgccgcctgaggactcccgtgacgtcgtattccgtcgtcggacctccgtaacttcggtacggaaaccacgacgtccactacgtcaaccatccgacggacccgggaccaggtacctaggtaggtacgtacggacgggtacttaccggtaacgtttaagttaccgttacggtaccgaccgggtaccggggtacgggtaaacgtaacggaacggtacccgtaacgttacggttcgggggttaccgggttccggggaccggggtaaccggggacccgtacgggtaccggtaccggtacccgggttaaccgtcggggtaccgaacccggtacccggaaaccggtccgtacccccggtcccccgg

SEQ ID NO: 314515 - DNA, 512 bp, Homo sapiens
  misc_feature: GZ8MTXP02FXEAR.52.4.A04.1.454.CMB.2.raw
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (353)..(353): a, c, t, g, unknown or other
  misc_feature (353)..(353): n is a, c, g, or t
  modified_base (443)..(443): a, c, t, g, unknown or other
  misc_feature (443)..(443): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtccgtctcccgaggacagacagccagcatcagctgttctgagataaatggagataatntgttcngtatcgacagacgccaggccagtccgctgtcctggtcatctatcacgataagacgccggtaccctgagggtactccgtagacgcgtacttcgcgtcggctccatcgtaggaaccncacgcctactcacgaccatccgaacggccggaccagggtctagtggatcggagtctagacttattacgtgacgacgtcgtagacaagganactagtcgtagggtgtaccggggcggacgacgacgctcgacgtcgacgcgacgccgacgcctccgtccg

SEQ ID NO: 314516 - DNA, 577 bp, Homo sapiens
  misc_feature: GZ8MTXP02GFYDW.52.4.A04.1.454.CMB.2.raw
  modified_base (156)..(156): a, c, t, g, unknown or other
  misc_feature (156)..(156): n is a, c, g, or t
  modified_base (217)..(217): a, c, t, g, unknown or other
  misc_feature (217)..(217): n is a, c, g, or t
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (318)..(318): a, c, t, g, unknown or other
  misc_feature (318)..(318): n is a, c, g, or t
  modified_base (322)..(322): a, c, t, g, unknown or other
  misc_feature (322)..(322): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtnactcagacaccgtcagtcgtccgtctcccaggacagacagccagcatcagctgttctgganataaagnggagtataaatatgttcnggtatcgcagagccaggccagtcgctgtcctggtcagtctatcaacgataagaacgcgaccctgagggtactccgngacncgtattctctacggctccgaaactcgtaacgggaaccaaccgtagccctaactctacgacccaagcgacggaccggaccacgtactagtggagtaggaggtctagtaacttagttacgtacgtacgacggcggtaggacgtaagacgactacgtcggttacgggtcggtacggggacgggacgggacgtacggtccgtacggtacccgtaacgtacggaccgaccggtacccgacggtcccgtacccggtccccg

SEQ ID NO: 314517 - DNA, 647 bp, Homo sapiens
  misc_feature: GZ8MTXP02IINRH.52.4.A04.1.454.CMB.2.raw
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttcngganataaatggagataatatgttctgatcgcagagcaggccagtcgctgtccnggtcatctatnacgataagagccgccctgaggactccgtgagcgtattctcgtcggcctccgtaaactcggtacgggaaccacgagccctactcgtcgaccctatccgacggcccgggaaccccaggtccgttaagtggggactcgggaacggtccgtaaggtactttaaacgttcgttcgttacgacgggtacccggtaggggaacaaaggtacgacgttaaccgttcggttacggggtttcggttcgggggaccggggtaaggggtaaacccgacgggggtccgttacccggggtaaaccggttccccggtttaaaacggggtcccgtaacgggaacccccgggttaagggccccgttaccccgggttacccccccgg

SEQ ID NO: 314518 - DNA, 530 bp, Homo sapiens
  misc_feature: GZ8MTXP02I1QOA.52.4.A04.1.454.CMB.2.raw
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (430)..(430): a, c, t, g, unknown or other
  misc_feature (430)..(430): n is a, c, g, or t
  modified_base (468)..(468): a, c, t, g, unknown or other
  misc_feature (468)..(468): n is a, c, g, or t
  modified_base (520)..(520): a, c, t, g, unknown or other
  misc_feature (520)..(520): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtcccgtctccccaggacagacagccagcatcagtcttgttctaggaagaataaaagtggaagtaataaatatgtttcctggtatcgaccagaagccaggccagtccgcctgtcctggtcatctatcacgataagagccgcctnaggatccgngacncgtattcgtcnggctccgacttcgcgggaaaccncacgccaactctagacccanacgacgccgggacccaggctagtcggatgaggctagacgtattacngtcacgtcgtgggacagacgcagtctggtcgttcgggngacgggccacggtcgtacggaccgtaacggacgtacgacgacccgacggccncgtacccccg

SEQ ID NO: 314519 - DNA, 756 bp, Homo sapiens
  misc_feature: GZ8MTXP02IOIZ5.52.4.A04.1.454.CMB.2.raw
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccaccgtcagtcgtccgtctccccaggacagacagccagcatcagtctgttctagganaataaaagtggaagtaataaattnttgtttcctaggtactcgaccaagaacgccgaggccagtccgcctgtcctggtctatctatcgaacgtataaacgacggccgacccgtgacgggtacttccccgtaggaacgtcctaacgtttccgtcgttacggacccttacccgtaactttcgggaacggggaaacccaccgaccggaccccttacttacccgtacgacccttaagtacccggaacgggaccccggggaaacccgtacgggttacccgttaaggtacggggaacgtcggggtaaaaccgggttcctttaaacggtaaaccttttaacgtttaacccgttcggggtaaacccgtacggggtaacccgggttagggaaaccgttaaacgggaaaccgttccgtacgttaccggggttggggttacccgggttaccggggacggggtaccgggaaaccgtcgggtaccggttacgacccggttcggtaacggtcccgacggtaacccgtacgggtcctcccggttacccccg

SEQ ID NO: 314520 - DNA, 658 bp, Homo sapiens
  misc_feature: GZ8MTXP02J17R8.52.4.A04.1.454.CMB.2.raw
tcagcgcagtacgacacgaccggtgctcgatttagagtagtgatcaggggctgggcctcaggaagcagcatcggaggtgcctcagccatggcatggatccctctcttcctcctcgtccttgcttactgcacaggatgtgtggcctcctatgaggtgactcagacaccgtcagtgtccgtctcccaggacagacagccagcatcagctgttctaggagaataaagtggaagaataaatatgtttcctggtatcgccaagaagccaggccagtcgctgtcctggtcatctatcaacgataaaggacgcggccctgacggggactcccgtgacgcgtattcctgcggtcctcccaaacgtcgtaacgggaaccacgaacgaccctacctcgtaccgaaccctacgtaccgaacggcccggggaccccaggggcccttaaggtacgggagtcggacgggtacctaggtaaccttagtttacccgtaggttaccgaacggcccgggttaaggggaacaacggaaacggtcctaacgttccggttacgggggtacgggttccgggggacgggtaaaccgggggaacccgaggggtccgttaaccgggacccggttccgtaacgggcccacgggtaccccgaacggggtcctcccggtcccccgg

SEQ ID NO: 314521 - DNA, 547 bp, Homo sapiens
  misc_feature: GZ8MTXP02GBGVR.52.4.A04.1.454.CMB.2.raw
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
  modified_base (451)..(451): a, c, t, g, unknown or other
  misc_feature (451)..(451): n is a, c, g, or t
  modified_base (537)..(537): a, c, t, g, unknown or other
  misc_feature (537)..(537): n is a, c, g, or t
tcagcgcagtacgacacgaccggtgctcgatttagagtagtgatcaggggctgggcctcaggaagcagcatcggaggtgcctcagccatggcatggatccctctcttcctcctcgtccttgcttactgcacaggatgtgtggcctcctatgaggtgactcagacaccgtcagtcgtccgtctcccaggacagacagccagcatcagctgttcngganataaatggagataatntgttcnggtatcgacagacgccaggccagtcgctgtcctggtaccatctatcacgaataacgacgccggacctgagggctcccgtgacgcgtattctcgtcggtactccgaaactcgtaagggaacctacgacgacccactctacgacccatcgaggcccggaaccgngtactagngagtgacggtntagtactatacgtcgacgcgtacggacgganaacgacgctacgtcgttcgggtcggtcgggacggaggaccgacggtcgtacgtaccggtcgtacggacgaccgaccggacggtccncccggtcccg

SEQ ID NO: 314522 - DNA, 551 bp, Homo sapiens
  misc_feature: GZ8MTXP02JUED0.52.4.A04.1.454.CMB.2.raw
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
tcagcgcagtacgacacgaccggtgctcgatttagagtagtgatcaggggtgggcctcaggaagcagcatcggaggtgcctcagccatggcatggatccctctcttcctcggcgtccttgcttactgcacaggatgtgtggcctcctatgaggtgactcagaccaccgtcagtgtccgtctccccaggacagacagccagcatcagctgttctggagaataaaatggaagataaatatgttcctggtatcgccagaagccaggccagtcgcctgtcctggtcatctatcacgataagaacgcggaccctcgacgggactcccgtggacgcgtattcctcgtcggacctccactccgtaggggaaccacgacgaccacgttcagacccatccgacggccgggacccaggctagtcggatgagctgactatacngtcngcgtaggacagacncgtacgtcgtggtcgtacgggcggacgggaccgaggtaccgtcggacccgttacgaacggtccgaacggcccgaacggtcccgttacgcccccggttccgg

SEQ ID NO: 314523 - DNA, 628 bp, Homo sapiens
  misc_feature: GZ8MTXP02ISV1Q.52.4.A04.1.454.CMB.2.raw
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccaccgtcagtgtccgtctccccaggacagacagccagcatcagctgttctgganaataaatggagataatntgttctggtatcgcagaacgccaggccagtcgcctgtcctggtcatctatcacgataagacgccggccctagagggactcccgtgacgcgtattcctcgtcggccctccgaaacttcgtacgggaacctacgcgacctactcacgaacccataccgacggcccgggaacccaggggtacttaacggtgggacgtacggacggtctaacgtaacgtttaagttccgtacggtaccgacgggtaccggtaagggaaccgtaaggtaccgaccgtacgttcggttggggttaccgggttacggggaccgggtaacgggtaccgacgggtccgtacggtaacccgttaaccggtacggtaccgaccggaccgtaccggtcccgtacccggtccccgg

SEQ ID NO: 314524 - DNA, 608 bp, Homo sapiens
  misc_feature: GZ8MTXP02GEITG.52.4.A04.1.454.CMB.2.raw
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (323)..(323): a, c, t, g, unknown or other
  misc_feature (323)..(323): n is a, c, g, or t
  modified_base (364)..(364): a, c, t, g, unknown or other
  misc_feature (364)..(364): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccaggacagacagccagcatcagctgtctgagataaatggagataaatntgttcnggtatcgacagaagccaggccagtcgcctgtcctggtccatctatcacgataagagccggccctgaggactcctgagcgattcncgtcggctccaactcgtacggaaccacgacgcctaactcgnaaccctagaccgacggacccggggacccagggtaccttaggtcgggaacttgggaaacggtccttaggtaacctttaaattacccgttggtaccgaacgggtcccggttagggggaacccttaaggaaacggcctaacgttccggtgggttacggttccggggacgggtaacgggacccgtaggggtctacggtaccgtaaccgttaacggcaccggaccgaacgggtcctaccggttcccccg

SEQ ID NO: 314525 - DNA, 561 bp, Homo sapiens
  misc_feature: GZ8MTXP02GFOGU.52.4.A04.1.454.CMB.2.raw
  modified_base (217)..(217): a, c, t, g, unknown or other
  misc_feature (217)..(217): n is a, c, g, or t
  modified_base (350)..(350): a, c, t, g, unknown or other
  misc_feature (350)..(350): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctgganataaatggagataatatgttcctggtatcgcagaagccaggccagtcgcctgtcctggtcatctatcacgataagacgcggccctgaggactccgtgagcgtattctcgtggctccaactcgtagggaaaccncgacgcccactctgaacccatacgacggcccgggaccagggctaagtggagtggacggtctacggtaacttagttacgtacggtacgaacggccggttaaggggacaaggaacgcctagtcgtgggtcgttcggggacggacggggccacgggtccgtacggtacccggtaacgtacggacgacggaccgaacgggcctaccggtcccccg

SEQ ID NO: 314526 - DNA, 604 bp, Homo sapiens
  misc_feature: GZ8MTXP02IANXU.52.4.A04.1.454.CMB.2.raw
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (409)..(409): a, c, t, g, unknown or other
  misc_feature (409)..(409): n is a, c, g, or t
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtcccgtctccccaggacagacagccagcatcagtctgttcgtaggataataaagtggaagtaataaattagttcgtttcgtgtactccgacaagaacgccgaggccacgtccgccgttgtccgtggtctatctagacgaacgaataacggaacgccggcctagnggacctccgngacgcgtacttctcgtgtcctcaccgttggacgggaacacgacgcctactcgacgacctancgaacgggcccgaaccgngtactagagtagngtacgcgttacgtacgttacgtacgtcgtacgacggtcggtacggacgacgacgtccgttacgtcgggtacgggtcggtacggggacggacgggacgtacgggtccgtaccggtaccggtaacgtacggaccgaccggaccggtacggcccgtcccggtccccg

SEQ ID NO: 314527 - DNA, 612 bp, Homo sapiens
  misc_feature: GZ8MTXP02FZZEE.52.4.A04.1.454.CMB.2.raw
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccgaggacagacagccagcatcagctgttctggagaataaaagtggaaggaattaaatattgtttcctaggtatcgaccaagaacgccaggccagtcgcctgtcctggtcatctatcacgaataagagccggccctgaggactcctgacgcgtattctacgtcggactccaaacgtcgtaacggggaaaccacaacggaccctactaccgtacgaacccatccgaagggacccggggaaccccaggggaccttagtgggaaattcggggaaaggtcctaggtaaaccttagttaccgttaggtacgaacggtcccggggtagggaaccaaaggacgactacgttcgtgggtcggttacggggacgggaacgggacacggcgtacgaccgttccgaaggtccgaacgcccgaaggtcctaccgtcccccg

SEQ ID NO: 314528 - DNA, 536 bp, Homo sapiens
  misc_feature: GZ8MTXP02F5C1N.52.4.A04.1.454.CMB.2.raw
  modified_base (241)..(241): a, c, t, g, unknown or other
  misc_feature (241)..(241): n is a, c, g, or t
  modified_base (419)..(419): a, c, t, g, unknown or other
  misc_feature (419)..(419): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgtctggagataaatggaagataaatatgtttcnggtatcgcagagccaggccagtcgctgtcctggtcatctatcacgataagaagccggccctacgagggactcccgtgagcgtattctcgtggtcctccgaaactcgtagggaaaccacgacgccactctgacccatcgagcggacccaggctagtgatgagctagacttatactagtnacgccgtaggacagagcacgtcgtggtcggttacggcgggaacggaacccggacggtaccgtacggtacccgtaacgtacggtaccgaccgacccgacggtcccgtacccgtccccg

SEQ ID NO: 314529 - DNA, 597 bp, Homo sapiens
  misc_feature: GZ8MTXP02F8WNP.52.4.A04.1.454.CMB.2.raw
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctcccaggacagacagccagcatcagctgttctgganataaagtggagataatntgttcngtatcgcagagcagcagtcnctgtctgtcatctatcacgaataacggacgccggccctacgagggtactcccgtgacgcgtattccgtcgtcggtcctccgtaactcgtacgggaaccaccgaacgtcccacttccgtacgaaccctagtaccgacgggacccgggtaccccagggtcctaagtgggacgtggaacggtctagtaaccttagttacgtcggtacgacggtccggtagggacaggaacgcgtacgtacggttgggtacggttccggggacgggacgggaccgtacggtcgtaccggtaaccgtccggtacggtcgacccggtaccgacggtcccgtacccggtcccccg

SEQ ID NO: 314530 - DNA, 619 bp, Homo sapiens
  misc_feature: GZ8MTXP02IAX21.52.4.A04.1.454.CMB.2.raw
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (368)..(368): a, c, t, g, unknown or other
  misc_feature (368)..(368): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtcctctcccaggacagacagccagcatcagctgttcngganaataaagtggagaataaatatgtttcctggtatcgaccagaacgccaggccagtcgcctgtcctggtcatcatcacgataagacgcgccctgagggactccgtgacgtcgtaattcgtcgtcggtctaccctaacgtcgtacgggaaaccacncggaccctacctctacgaaccctacgtccgacggacccgggaacccagggaccttaagtcgggatacggagggtacctagggtaacttagttactcggtacaggtcccggttagggaacaagggaactcgtaacgtcggttcgggtaggtttccggggacgtaacgggggaccgaacggggtccttaaccggacccggttaaccgtaacgggtacacccggacccgaacgggtcctttacccggcccccgg

SEQ ID NO: 314531 - DNA, 645 bp, Homo sapiens
  misc_feature: GZ8MTXP02IFOET.52.4.A04.1.454.CMB.2.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (387)..(387): a, c, t, g, unknown or other
  misc_feature (387)..(387): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccacgtcagtgtccgtctcccgaggacagacagccagcatcagcttgttcagganaataaagtggagaataaatnttgttctgatcgacagaacgccaggccagtccgcctgtcctggtacatctactcaacgataaaggacggcccggtacccctaggacgggactcccgtaggacgcgtactttcgtcgtcggacccttccgaacgttccgtaagggaaccncgaacgcctactccgtacgaccctagccgaacgggcccggggaacccaggggtaccttaggttagggacttacggggaaggttcgtaacggttaacttaggttactcggtacgtacggccggttaacgggacgtaacgagtcgtaaccgtcggttacgggtcggtcggggacggggaaacggccgacggtccgtccggtaccggtcccggttaaggcccgaacccggtacccggtacggtcccgtacccggtcccccg

SEQ ID NO: 314532 - DNA, 629 bp, Homo sapiens
  misc_feature: GZ8MTXP02JJ0JQ.52.4.A04.1.454.CMB.2.raw
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (325)..(325): a, c, t, g, unknown or other
  misc_feature (325)..(325): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccaggacagacagccagcatcagcttgtctagganaataaagnggaagataatntgttctggtatcgacagacgccaggccagtcgcctgtcctggtcatctatcaacgaataagacgccgaccctagacgggactcccgngacgcgtacttccgtcgtcggcctaccgtaaacgtcgtacggggaaaccacgacgccctactcgtacgaaccctagtaccgaacggacccgggaacccacggacttacggtaggagttacggaacgggtcttaacgtactttacgttaacgtcggtaccgaacggtcccggtagggaaccgaggaactccgtaacgtcggttacgggtcggttacggggcgggaacgggaccgtacggtacgtaccggtaccggtaacgtacgggtaccaccggacccgtaacgggtcccgtaccgtcccccgg

SEQ ID NO: 314533 - DNA, 645 bp, Homo sapiens
  misc_feature: GZ8MTXP02IN5G6.52.4.A04.1.454.CMB.2.raw
  modified_base (243)..(243): a, c, t, g, unknown or other
  misc_feature (243)..(243): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaatggagataatatgttctgtancgcagagccaggccagtcgcctgtcctgtcatctatcaacgataagacgccgccctgagggtactcccgtgacgtcgtacttctacgtcggcctccctaaactcgtacgggaaaccaccgacgtaccacgtctacgacctagtccgacggcccgggacccagggtctagtgggtatggaacggcgttacggtaactttaagttccgtaggttaccgacggtacccgggttaggggaacaacgggaaactcccgtacggttcgtttcgggggtacggttacccgggggacggtaaacgggggccgtaacgggggtcccgttcggggtaaacccggttccggttaaacgggtcccgaacgttaccccgggaacggtcccccggttaacccggttcccccccggg

SEQ ID NO: 314534 - DNA, 597 bp, Homo sapiens
  misc_feature: GZ8MTXP02HXQNQ.52.4.A04.1.454.CMB.2.raw
  modified_base (322)..(322): a, c, t, g, unknown or other
  misc_feature (322)..(322): n is a, c, g, or t
  modified_base (346)..(346): a, c, t, g, unknown or other
  misc_feature (346)..(346): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccaggacagacagccagcatcagtcttgttcgtaggaagaataaaagtggaagtaataaattatgtttacctggtatcgaccaagaagccaggccagtccgctgtcctggtcatctatcacgtataaagagccgcccngacggctcccgtgacgcgtattcngtcgctccgacttcgaggaccagacgccacgttcacgaacctagtcgacggacccgggtacccagggtccttaagggngacgnggacgtactacgttacgttacgttacgtacggtacgacggaccggtacggaacgacggtacgcgtacgttggtacgggttcggtacgggacgggtacggaccgacggtccgtaccggtaccgtaaccggtcgaccgaccggacccgtaccggtccgtacccgtccccg

SEQ ID NO: 314535 - DNA, 538 bp, Homo sapiens
  misc_feature: GZ8MTXP02FSYV3.52.4.A04.1.454.CMB.2.raw
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
  modified_base (346)..(346): a, c, t, g, unknown or other
  misc_feature (346)..(346): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccaggacagacagccagcatcagctgttctgganataaanggaagataaatntgttcnggtatcgcagaagccaggccagtcgctgtcctgtcatctatcacgataagagccggccctgaggactccngacgcgattcnctgctccgaactcgtaggaaccncacgccactcacgacatcgagccgacccaggcttaaggnggancggagtctagtacttagtacgtacgacgacgtcggtaggacaagacgctacgttcggtacggtcggtaccgggacgggaacggaccgacgggtaccgtacggtacccggtgacggtaccgacggacccgaacgcccgtacccggccccg

SEQ ID NO: 314536 - DNA, 505 bp, Homo sapiens
  misc_feature: GZ8MTXP02FIMKZ.52.4.A04.1.454.CMB.2.raw
  modified_base (461)..(461): a, c, t, g, unknown or other
  misc_feature (461)..(461): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgcagaagccaggccagtcgcctgtcctggtcatctatcacgataaagaagcggccctcagggatcctgagcgattctctggctccaacgtctagggaaaccacgacgccactctgacccatcagcgggacccaggctatggactgaggctagactatactgtcagccgtgggacagagcactctggtgttcggcggacgggaccgaggtcncgaccgtaacgtacggtcacggcccgaaaggccgtacgcccccg

SEQ ID NO: 314537 - DNA, 593 bp, Homo sapiens
  misc_feature: GZ8MTXP02GFX1K.52.4.A04.1.454.CMB.2.raw
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttcnggagataaatggagataaatntgttcnggtatcgcagaagccagccagtcgcctgtcctggtcatctatcacgaataagacgccggccctgaggtactcccgtaggacgcgtatttccacgttcggacctcccaaagtccgtaagggaaacccacacggccctaactccgtacgaacctacacgacggacccggggaccccaggtacctaagtacgggaactggaaacgggtccttacggaacttaattaccgtgtaccgaacggtccggtagggaccaggaacgtcgtaacgttcgtgggtcggttcccgggagggacgacgacggtcgtacggcccgttaacgtacgtcgacgaccgaacggtccgtacgtcccccgg

SEQ ID NO: 314538 - DNA, 568 bp, Homo sapiens
  misc_feature: GZ8MTXP02GOP9O.52.4.A04.1.454.CMB.2.raw
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccaggacagacagccagcatcagctgtctgganaataaatggagataatntgttcngtancgcaganccaggccagcnctgtctgtcatctatcgagataagacgccggcctgagggactccgtagacgtcgtattcctgtcgctaccgaactcggtacggaaccacgacgacctactctacgaacccaatccgaacgggcccgggaaacccgtcggtactaggtcggtagtcggacggtctacggtacttacgttacgtacgtacgtacggcggtacggaacaacgacgtactcgtggtcgggtcggtcgggacggacgggacgacggtccgtaccgaccgtcggtacggtaccgacggtccgaacggtcccgtaccggcccg

SEQ ID NO: 314539 - DNA, 566 bp, Homo sapiens
  misc_feature: GZ8MTXP02H6X5N.52.4.A04.1.454.CMB.2.raw
  modified_base (242)..(242): a, c, t, g, unknown or other
  misc_feature (242)..(242): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (444)..(444): a, c, t, g, unknown or other
  misc_feature (444)..(444): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagaccaccgtcagtcgtccgtctcccgaggacagacagccagcatcagtctgttcaggataataaagtggaagtaataaattntgttcgtggtatcgacagaacgcaggcagtcgcctgtcctgtcntctancaacgataagacgcgacctagaggactccgtgacgcgtatcgtcgtcgcctccaacgttcgacggaacacacgacctactccagactacgcgacgggcccggaacccaggtactaggacggagtacggaggtcttaggaactttagttaccgngtacggacgccggtagggacaaggacgctacgtcggttggtacggtaccggggacggaacgggccacggcgttacggaccgttaacgtacggacgaccgacgacggtcctacccggtccccg

SEQ ID NO: 314540 - DNA, 638 bp, Homo sapiens
  misc_feature: GZ8MTXP02JY25I.52.4.A04.1.454.CMB.2.raw
  modified_base (216)..(216): a, c, t, g, unknown or other
  misc_feature (216)..(216): n is a, c, g, or t
  modified_base (251)..(251): a, c, t, g, unknown or other
  misc_feature (251)..(251): n is a, c, g, or t
  modified_base (282)..(282): a, c, t, g, unknown or other
  misc_feature (282)..(282): n is a, c, g, or t
  modified_base (352)..(352): a, c, t, g, unknown or other
  misc_feature (352)..(352): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgtctgganataaagtggagataatatgttctggtatcgcaganccgagcagtcgctgtctgtcatctatcaganaagacgccgcctcgacggactccgtagacgcgtacttctcgtcggcctccaacgtcggtaacgggaaccnccgtaacgccctaccgtcgtaccgaaccctacgtaccgaaccggggcccggggaaccctagggaccgttaaggtcgggtagtacgggaacgggttccttaacgggtaaccctttagtttaacccgtcgggttaccgacggttccggggagggaacccaaggtaacgccttacggtcgttacggggtccggtacggggaccggggtaaacggtccgtacggtccgtaccgtaacccggttcgtacggtacccgacggacccgtaacggcccgtccccgttaccccgg

SEQ ID NO: 314541 - DNA, 668 bp, Homo sapiens
  misc_feature: GZ8MTXP02INV27.52.4.A04.1.454.CMB.2.raw
  modified_base (219)..(219): a, c, t, g, unknown or other
  misc_feature (219)..(219): n is a, c, g, or t
  modified_base (265)..(265): a, c, t, g, unknown or other
  misc_feature (265)..(265): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccaccgtcagtcgtccgtctccccaggacagacagccagcatcagctgttctgganaataaatggaagataaatatgttctgtatcgcagagcagccagtcnctgtcctggtcatctatcagataagacgccgccctagagggactcccgtgacgcgtactttctacgtccggctacccgtaacttccgtacgggaaaccaccgtacgaccctaacctctacgaccctagtaccgacgggacccggggaacccacgggtaccttaaggtacggtaaagttcgggaaacgggtccttacgggtaaacctttaagtttacccgtaggttaacccgacggggtacccggttagggggtaaccgaaaggaaccggtaccgtaacgttccggtttaggggtccgggtttaccggggaccggggtaacgggacccgtacgggccgttacgggaccccgttaacgtacggtaccgaaccggtacccgaacggtcccgtcccggtacccccgg

SEQ ID NO: 314542 - DNA, 525 bp, Homo sapiens
  misc_feature: GZ8MTXP02IBCNB.52.4.A04.1.454.CMB.2.raw
  modified_base (169)..(169): a, c, t, g, unknown or other
  misc_feature (169)..(169): n is a, c, g, or t
  modified_base (250)..(250): a, c, t, g, unknown or other
  misc_feature (250)..(250): n is a, c, g, or t
  modified_base (270)..(270): a, c, t, g, unknown or other
  misc_feature (270)..(270): n is a, c, g, or t
  modified_base (323)..(323): a, c, t, g, unknown or other
  misc_feature (323)..(323): n is a, c, g, or t
  modified_base (379)..(379): a, c, t, g, unknown or other
  misc_feature (379)..(379): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtgcctctatgaggtgactcagaccaccgtnagtgtccgtctcccgaggacagacagccagcatcagctgttctaggataataaaagtggaagaataaatatgtttctgtancgcagaacgccaggcagtcnctgtcctggtcatctatcaacgataacgaagtccggcctacgagggactccgngacgctatccgctcggctaccaacgttcagggaaccactcgaccactcgagaccancgacggccggaccagctagagngngagngtagatatatgtcgacgacggagacgacgacgacgtacgtcgtcggtggtcgggacgggacggacggacggacgtacgaccgtaaccgtacgacgacgaccgacggccgtaccgcccg

SEQ ID NO: 314543 - DNA, 634 bp, Homo sapiens
  misc_feature: GZ8MTXP02JX4D1.52.4.A04.1.454.CMB.2.raw
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (276)..(276): a, c, t, g, unknown or other
  misc_feature (276)..(276): n is a, c, g, or t
  modified_base (323)..(323): a, c, t, g, unknown or other
  misc_feature (323)..(323): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagaataaatggagataatntgttcngtatcgcagagcagccagtcgctgtctgtcatctancacgataagacgccggccctgagggactcccgtagacgcgtattccncgtcggacctccaactcgtacgggaacacacgccactctacgacctagtacgacggacccgggacccgacgggtactaaggtagggtacgtacgggacgggtcttacggtaaccttaagtttacccggtaggttacccgacggtacccgggttacggggaaaccgaaggaaccggtaccgtacgtttccggttagggggttcgggttaccgggggacggggtaaaccgggaccggtacgggtccgtacggtaccccggtaacgtaacgggtaccacggtaccccgaacggtccccgtaccggtacccccgg

SEQ ID NO: 314544 - DNA, 580 bp, Homo sapiens
  misc_feature: GZ8MTXP02I7IBU.52.4.A04.1.454.CMB.2.raw
  modified_base (213)..(213): a, c, t, g, unknown or other
  misc_feature (213)..(213): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (446)..(446): a, c, t, g, unknown or other
  misc_feature (446)..(446): n is a, c, g, or t
tcagcgcagtacgacacgaccggtgctcgatttagagtagtgatcaggggtgggcctcaggaagcagcatcggaggtgcctcagccatggcatggatccctctcttcctcggcgtccttgcttactgcacaggatgtgtggcctcctatgaggtgactcagacaccgtcagtgtcccgtctccccaggacagacagccagcatcagctgttcnggaagaataaaagtggaagaataaatntgttcnggtatcgcagancagccagtcnctgtcngnatctancanataacgacgcggcctagaggtctccgtgacgtcgattctactggccttacacgtcgtacggaaacctcacgcctaccgtctacgaccctagacgacgggaccggaacccgaggccgttaaagtaggtaacgtgaacgggtactacgtaacttattaaccgnggttaccgacggtccggtacggaaccgagtaacgctaacgtcgtcggtcggtacgggcgggacggaccgtaggccgtacggtaacccgtcgtaacggacgtaccgaccgaacggcccgtaccgccccgttccgg

SEQ ID NO: 314545 - DNA, 703 bp, Homo sapiens
  misc_feature: GZ8MTXP02FSMRT.52.4.A04.1.454.CMB.2.raw
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccaggacagacagccagcatcagtctgttcngganaataaagtggaagaataaatatgtttctggtatcgccagaagccaggccagtcgcctgtcctggtcatctatcacgataagagccggccctgaggtactccctgacgtcgattctcgtcggcctccaaactcgtagggaaaccacgacgacctactctacggaacccctagtaccgacggcccggggtaaccccaggggtaccttaaggtgggaaacttcgggaaacggggtcccttaagggtaccgtttaaactttaaccgttcgggttaacctaccggggaccccgggttagggggaaacctaaacgggaaacgtcccgtaacgtttaccgggtagggggtttcggttcccgggggacggggaaacggggttacccgacggggtacccgttacggtaacccccgggttaacggttaacccgggtacgaaacccgggacccccggtaaaacgggtccccgttacccggggtttacccccccgg

SEQ ID NO: 314546 - DNA, 648 bp, Homo sapiens
  misc_feature: GZ8MTXP02F9PWK.52.4.A04.1.454.CMB.2.raw
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctcccaggacagacagccagcatcagctgttcngganataaanggagataatntgttcngtatcgcagacgcagccagtcnctgtcctgtcatctatcacgataagacgccggaccctagacgggactcccgtggacgtcgtattccgttcgaccggtcctacccgaaacttcggtaacggggaaaccaccgaacgcccacttacacgaaaccctactacggaaccggcccgggggtaaccccagggtaccttaagttagggaacgttaggaaacgggtccttaaggtaacccttagtttaccgtaacggttccgaacgggtacccgggtaggaaccgtaaaagaccggtacctacgttccggttaggggttccgggttacggggacgggtaacgggtaaccgcggttaccgacggtacccggttaacgtacggggaccacggccccgaaaggcccgtcccgtccccgg

SEQ ID NO: 314547 - DNA, 584 bp, Homo sapiens
  misc_feature: GZ8MTXP02G9KGP.52.4.A04.1.454.CMB.2.raw
  modified_base (155)..(155): a, c, t, g, unknown or other
  misc_feature (155)..(155): n is a, c, g, or t
  modified_base (220)..(220): a, c, t, g, unknown or other
  misc_feature (220)..(220): n is a, c, g, or t
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (386)..(386): a, c, t, g, unknown or other
  misc_feature (386)..(386): n is a, c, g, or t
  modified_base (535)..(535): a, c, t, g, unknown or other
  misc_feature (535)..(535): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtnactcagacaccgtcagtcgtccgtctccccgaggacagacagccagcatcagcttgttctagganaataaagtggaagataatatgttctgtancgcagagcagccagtcnctgtctggtcatctatcaacgataagacgccgccctagacgggactccgtagacgtcgtattcctcgtcgcctaccgtaactcggtacgggaacacgacgccctaactctacgaacctanaccgaggacccgggacctaacgggctaaggtcggatacgggaacggtccttaagtaccgtttaacgttcgtacggttaccgaacggtccggtaggggaaacctaaggaccgtacgtacgttcggtagggtcggtacgggcggacggacncggctacggaccgtcgtcgaccgacgtaccgacggccgtcgtcccccgg

SEQ ID NO: 314548 - DNA, 586 bp, Homo sapiens
  misc_feature: GZ8MTXP02FTLBZ.52.4.A04.1.454.CMB.2.raw
  modified_base (159)..(159): a, c, t, g, unknown or other
  misc_feature (159)..(159): n is a, c, g, or t
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactnagacaccgtcagtgtcccgtctccccaggacagacagccagcatcagcttgttctagganaataaaagnggaagtaataaatnttgtttcnggtatcgacagacgccagccagtcnctgtcctgcatctancagaataaacggacgccgccctagaggtctccgagacgtcgtattctctacgacctccgtaactcggtaaggaaccacgtacgccctactctacgaacctagaccgacggaccggacccaggtctagtgagtcggaacgtctaagtacttattacgtacgtacacggcggtaggaactaaggactacgtcgtcggtgggttcggtaccggggcgggaacggtacccgaggtacctcgggacccgttcggtaaccggacgtaccggtaaccgtacggtcccgtcccgttacccccgg

SEQ ID NO: 314549 - DNA, 680 bp, Homo sapiens
  misc_feature: GZ8MTXP02I69RK.52.4.A04.1.454.CMB.2.raw
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (406)..(406): a, c, t, g, unknown or other
  misc_feature (406)..(406): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacaccgtcagtcgtccgtctccccgaggacagacagccagcatcagtcttgttcgtaggaagtaaattaaaagtgggaaaggtaaattaaaattagttcgttttaccgtggtaactcgaccaagaacgccgaggccagtcgcctgtccnggtcatctancagaataagacgccgaccctagacggactcccgtagacgtcgtactttccgtcgtcggcctaccgtaactcggtaacgggaaaccncgaacgtccctactcgtacgaacccagtaccgaacgggacccgggaaccctacgggacttaacggtagggtaacgtcggaaacgggttacctaaggtaaacccgtttaattacccgtacgggtaccgaaacgggtccggtaagggggaaccaaagggtaccgtaccgtacgttcggttacgggttcggttaccggggacggggaacggtaccgacggggtacctacggaaccgtcccgtaggaccgacgacccgacggccgtacccgtccccgg

SEQ ID NO: 314550 - DNA, 559 bp, Homo sapiens
  misc_feature: GZ8MTXP02FGUGH.52.4.A04.1.454.CMB.2.raw
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (391)..(391): a, c, t, g, unknown or other
  misc_feature (391)..(391): n is a, c, g, or t
tcagcgcagtacgacacgaccggtgctcgatttagagtagtgatcagggggctgggcctcaggaagcagcatcggaggtgcctcagccatggcatggatccctctcttcctcggcgtccttgcttactgcacaggatgtgtggcctcctatgaggtgactcagacaccgtcagtgtccgtctcccaggacagacagccagcatcagctgttcnggagataaaanggagataatatgttcnggtatcgacagagcaggcagtcgctgtccngcatctatcacgaataagacgcggtccctagagggactcctagacgcattccatcggctaccaactcgaggaaccacacgacccatcagacctacacagccgggacccaggtacttaaggngagtagagtctagtactattacgtcgtacgacggacggtaggaacgacggaacgccgtacgtacggtcgggttacggtacggggacgggaacgggaccgacggtaccgtacggtacccggtaaccgtacggtacgaccggtacccgaacggcccgtcccgtaccccgg

SEQ ID NO: 314551 - DNA, 670 bp, Homo sapiens
  misc_feature: GZ8MTXP02HR4GN.52.4.A04.1.454.CMB.2.raw
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctccccaggacagacagccagcatcagctgttctgganaataaagnggagataaatntgttcngtancgcagancagcagtcnctgtcctggtcatctatcacgtataaagacgcggccctgagggactcccgtgagcgtattcgtctacggcttccgaaacttcgagggaaccacgacgaccactctacgaaccctagtaccgaacggacccggggaaccccaggggtacccttaaaggttcggggaattacgggaaggttcccgttaaggtaacctttaaacttacggttcgtacgaacggtcccgggttagggaaccaaggtaaaccgccgtaacgtttccggttgggggttccgggtttcgggggaccggggtaaacgggggtacccctaagggggccctttacggggaaccccggtttaaccgtaaacgggggttcccaaacgggccccggtaaacggccccgtttaacccggggttcccccccg

SEQ ID NO: 314552 - DNA, 525 bp, Homo sapiens
  misc_feature: GZ8MTXP02IRRNP.52.4.A04.1.454.CMB.2.raw
  modified_base (218)..(218): a, c, t, g, unknown or other
  misc_feature (218)..(218): n is a, c, g, or t
  modified_base (421)..(421): a, c, t, g, unknown or other
  misc_feature (421)..(421): n is a, c, g, or t
  modified_base (442)..(442): a, c, t, g, unknown or other
  misc_feature (442)..(442): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccaccgtcagtgtccgtctccccaggacagacagccagcatcagctgttctgganaataaaagtggaagaattaaatattgtttcctggtatcgccagaagccaggccagtcgcctgtcctggtcatctatcacgataaagagcgccctgagggactcccgtgacgcgtacttctcgtcggcctccgaaacgtcgtacgggaacacgagcccactctgaccatacgacgccggaccaggctagtcgatgagctgactnttactgtcgagccggtagganagagcagtcgtggtcgtcggcggacgggcgacggcgtaccggtaccgtcgtacggcgacgtccgaacggtcctaccgaccccg

SEQ ID NO: 314553 - DNA, 681 bp, Homo sapiens
  misc_feature: GZ8MTXP02F14C5.52.4.A04.1.454.CMB.2.raw
  modified_base (217)..(217): a, c, t, g, unknown or other
  misc_feature (217)..(217): n is a, c, g, or t
  modified_base (292)..(292): a, c, t, g, unknown or other
  misc_feature (292)..(292): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagtctgtcagganaataaagtggaagtaataaatattcgttctggtactcgacagacgcgagccagtcgcctcgtactgtacatctancacgaataagacgccgccctagaggactccgtagacgcgtacttctcgtacggcctaccgacgttcggaacgggaaaccacgacgacccacttaccgacgaccctagtaccgacgggacccgggaacccgaggggtacttaagggtcggtaagtacggacgggtaccttaggtaaaccctttaagttcgtacgtaccgtaaaccgggccgggttaacgggacgtaaacggtaaccgccgtaacggttacccggttaggggtttccgggttaaccggggacgggggaaaacgggcccgttaacggggccgtaccggtaaaccccggtcggttaaaacccggcgtacccgggaccccgtaaacggtccccgttacccggttaccccccggg

SEQ ID NO: 314554 - DNA, 604 bp, Homo sapiens
  misc_feature: GZ8MTXP02G3EUR.52.4.A04.1.454.CMB.2.raw
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (318)..(318): a, c, t, g, unknown or other
  misc_feature (318)..(318): n is a, c, g, or t
  modified_base (360)..(360): a, c, t, g, unknown or other
  misc_feature (360)..(360): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgaggtgactcagacacgtcagtcgtccgtctcccaggacagacagccagcatcagctgttcgtggaanataaagtggaagtataaatntgttctgtactcgcagacncagccagtcgcctgtcctgtcatctatcaacgataaacgacgccggacctgacggactccgngacgtctacttctcgtcgcctccaacgtcgtacgggaaaccncgactacctactcacaccactacgacggacccggaccgtacggactagtaggtacgtaggacgtacgtacgtacgttaacgttacgtcgtacgtacggtacggacggaacgaaacgacgtacgtacgtacggttcgggtacggttccggggaaccgggtacgggacggtaccggtccggtaccggtaaccggtaaccggtacggtaccgtaccggaccgtacggtccccgtacccggtccccgg

SEQ ID NO: 314555 - DNA, 562 bp, Homo sapiens
  misc_feature: GZ8MTXP02I3899.52.4.A04.1.454.CMB.2.raw
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctcccaggacagacagccagcatcagctgttctggatataaatggagataatntgttctaggtatcgcagacncaggccagtcncctagtcctggtcatctatcaacgatagacgcgccctgaggacttccgagcgcattcgctcggcttccaactcgtacggaacnctacgccattccnaacctacncgaacgccggggaaccnggacttagnggattgaacggtctaggacttacgtaccttgtacacggtccggtagggaacacgagtactagtccggtagggtccggtgggacgggacgggaaccacggactaccgggtaaccgttcgaacgggtttacgaaccggtccgaaacggggtcctacccggggtacccccg

SEQ ID NO: 314556 - DNA, 558 bp, Homo sapiens
  misc_feature: GZ8MTXP02FKI8G.52.4.A04.1.454.CMB.2.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctcccaggacagacagccagcatcagctgtctggagataaanggagataanatgttcngtatcgcagagcagcagcgctgtcctggtcatctatcacgataacgaagcggaccctcgagggtactccgtgacgcgattcacgtcggctccaactcgtcgggaaacacgaacgccaactctacgaccatcgacgaccggacccaggctagtggatcggaaggctgactagtactcgtgacgccggtagggaaccaggaacgcgtaaacgtcgtagggttcgggttaccggggacgggaacggggtaccgacgggaccgtcgggaacccgttccggtaaggttcccgacggacccgaaacggccgttcggtacccccccgg

SEQ ID NO: 314557 - DNA, 656 bp, Homo sapiens
  misc_feature: GZ8MTXP02JJNKY.52.4.A04.1.454.CMB.2.raw
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
  modified_base (296)..(296): a, c, t, g, unknown or other
  misc_feature (296)..(296): n is a, c, g, or t
  modified_base (330)..(330): a, c, t, g, unknown or other
  misc_feature (330)..(330): n is a, c, g, or t
  modified_base (373)..(373): a, c, t, g, unknown or other
  misc_feature (373)..(373): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagcgcagtacgacacgaccggtgctcgatttagagtagtgatcaggggctgggcctcaggaagcatcatcggaggtgcctcagccatggcatggatccctctcttcctcggcgtccttgcttactgcacaggatgtgtggcctcctatgaggtgactcagacaccgtcagtcgtccgtctcccaggacagacagccagcatcagctgtctgganaataaagtggaagtaataatgttgtttccgnggtactcgaccagaacgccgaggccagtccgcctgtcctggtcatctancacgaataagacgccgacctagacggtactccgngacgtcgtattcgtcgtcgcctaccgaacgttcgtacggaacncgaaccgcctactcgacgaccctagtccgacggacccggggaaccngggtacttaggnggtaacgcggtaacgggtccttaaggtaaccgttttactttacgtaccgggttacgaccgggttaccgggtaaggggaaccaaggggaacctccgtacggttccgggtttaggggttccggttaccggggacggggtaaacggcccgtacggggtccgttaacccggaccgggttaacgtacggggtaccaccggtaccggaccggtccgtacccccgtccccgg

SEQ ID NO: 314558 - DNA, 600 bp, Homo sapiens
  misc_feature: GZ8MTXP02HJC0H.52.4.A04.1.454.CMB.2.raw
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (342)..(342): a, c, t, g, unknown or other
  misc_feature (342)..(342): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagaccaccgtcagtgtccgtctcccgaggacagacagccagcatcagctgttcngganaataaatggagataatatgttctggtancgcagancagccagtcgctgtctggtcatctatcaacgataagacgcgcctgaggctccgagagctattctcgcggctccaacgtcacgggaaccnctacgcctactcctacgacccagtcgacggcccggaccgaggacctaggtaggtagacgggtacggcgttacgtaccgtttaaagttccgttacgggttaccgaaccgggtccggttaaggggaccgaaaggaaccgtcgtacggttcggtcggggttaccgtccgggggacgggtacggggaaccgtcgggtacgtccggtaccgtaaccgtacggtaccgacggtacccggtaacggtcccgtacccggtcccccg

SEQ ID NO: 314559 - DNA, 518 bp, Homo sapiens
  misc_feature: GZ8MTXP02JAQY4.52.4.A04.1.454.CMB.2.raw
  modified_base (239)..(239): a, c, t, g, unknown or other
  misc_feature (239)..(239): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgtctggagataaatggagataatatgttccnggtatcgcagaagccaggccagtcgcctgtcctggtcatctatcacgataagagcggccctnagggactccngagcgattctctggcctccaaactcgtacgggaacacagcccactctgacccatcacggccggacccaggctacgtgggatgaggctgactatactgtcagcgtggacgagagtcacgtctagggtcgttcgggcgggaggaccgcggaccgtcgacccggtaaccgtacggtaccgacgtaccccgaaggtccctcggtcccccgg

SEQ ID NO: 314560 - DNA, 567 bp, Homo sapiens
  misc_feature: GZ8MTXP02GNMD2.52.4.A04.1.454.CMB.2.raw
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (331)..(331): a, c, t, g, unknown or other
  misc_feature (331)..(331): n is a, c, g, or t
  modified_base (362)..(362): a, c, t, g, unknown or other
  misc_feature (362)..(362): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctcccaggacagacagccagcatcagctgttctgganaataaagnggaagtaataaatattcgtttctggtactcgaccagaacgccagccagtcgcctgtctggtcatctatcacgataagacgcgccngaggctccgngngcgtatctntcggactccgaactgtaagggaaccacgacncctactaccgtacaaccactcgacgggacccgacccgacggtactacgtaggacgtggacgtactacgtaactttagtacgttacggagaccggtacggtaggaacgaaggacacgtacgtcgtgggtacgttaggggcggtacggacgtacgcgtacgtaccgtaacgtacggtacacggaccgacggtccgtaccgtaccccg

SEQ ID NO: 314561 - DNA, 603 bp, Homo sapiens
  misc_feature: GZ8MTXP02FNEUI.52.4.A04.1.454.CMB.2.raw
  modified_base (217)..(217): a, c, t, g, unknown or other
  misc_feature (217)..(217): n is a, c, g, or t
  modified_base (498)..(498): a, c, t, g, unknown or other
  misc_feature (498)..(498): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctgganataaatggaagaataaatatgttctgtatcgacagaacgccaggccagtcgctgtcctggtcatctatcaacgaataaagacgcggaccctacgagggactccgtgacgtcgtatttcgtcgtcggtcctccgaaacttcgtaacgggaaccaccgtacgaccctactctacgaaccctatccgaacggacccgggacccaggtacttaagtcgggtatggacggtcgtacgtaacttacttacgtcggtacgacggtccggtacgggaacgaaggtaacnccgtaacgtcggttggttacggttcgggacggggacggaccgacgggtcgtacggtaccggtaacgtacggacgaccgccgtaacggcccgtacccgtcccccgg

SEQ ID NO: 314562 - DNA, 764 bp, Homo sapiens
  misc_feature: GZ8MTXP02IN4TJ.52.4.A04.1.454.CMB.2.raw
  modified_base (227)..(227): a, c, t, g, unknown or other
  misc_feature (227)..(227): n is a, c, g, or t
  modified_base (654)..(654): a, c, t, g, unknown or other
  misc_feature (654)..(654): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtcgtccgtctcccaggacagacagccagcatcagtctgttcgagaataataaagnggaagtaaataaactgttcgttcgtaggtactaccgacgaaggaacacgacggaccacggtccgccgttacgttcccgtagggtacctaacttactactacgtaacggtaaaacgttaaaacgggaaccgggcccggtaccccgtaacgggacggggtaccccttccggaagtaccggtacttacttccgttcgtaccgacctacccgtaacgttcggaaaccggaaccaaccggctacctaaccgtcgtaccgaccctagcccgacgggaccccggagttacggtcttaaggcgttacgagcggtaactactaacgttaagttcgtacggaaccgttcggaccggtacgggaaagtacggaaaccgtcgtacggttcggttcgggggtccgggtttaccgggggacgggaacccgggggttaaacnccgggggttaaacccgtcgggttaaacccccggtttaaggtccggggaaaacccgttaccccgggaacccggtttaaaccgggcccccgttttacccggtaccccccggg

SEQ ID NO: 314563 - DNA, 598 bp, Homo sapiens
  misc_feature: GZ8MTXP02GSK5E.52.4.A04.1.454.CMB.2.raw
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (267)..(267): a, c, t, g, unknown or other
  misc_feature (267)..(267): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgtcngganataaagtggaagataaatatgttctggtatcgcagaacgccaggccagtcncctgtcctggtcatctatcagataagagcgacctgaggactccgtgacgcgtattccgtcgtcggacctccgaaactcgtacgggaaacaccgagcccacgtctacgaacctagacgacggcccgggaacccagggacttaaggaggatacgggacggtctacggaacttacgttacgtcggtaccgacggacccggttggggaactaaggaacgccgtaacgttcgttaggggtcggtttaccggggacgggtaacggggaccacggggtccgtaccggaacccgttccggtaacggtcgaccgacccggaacgtccgtccggtcccccg

SEQ ID NO: 314564 - DNA, 606 bp, Homo sapiens
  misc_feature: GZ8MTXP02GGJ6Q.52.4.A04.1.454.CMB.2.raw
  modified_base (276)..(276): a, c, t, g, unknown or other
  misc_feature (276)..(276): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggaagaataaaagtggaaggtaataaatattgtttcctggtatcgaccagacgcaggcagtcnctgtcctgtcatctatcaacgaataagacgccggaccctgagggactccgagagcgtattctcgtacgacctccaactcggtacggaacacgacgaccactcctacgaccatcgaggacccgggaccaggtctaaggtgatacggacggtactaggtacttaacgttacgtacggtaccgacgggtaccggtaggggactaaacggacgtaccgtacgttcggtagggttccgggttcggggacggggtaacggaaccgcggtccgtacgggtaccccgttaacggtacggacgaacccggccgaaccggtccgcccggttaccccccgg

SEQ ID NO: 314565 - DNA, 623 bp, Homo sapiens
  misc_feature: GZ8MTXP02GINWB.52.4.A04.1.454.CMB.2.raw
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccggtcagtcgtccgtctccccaggacagacagccagcatcagctgtctgganataaatggagtataactatgtttcnggtatcgcagaacgcctaggccagtcgcctgtcctggtccatcgtaatcgaacgataacggaaacgtccgggacccttacgaggggaaccttccccagggaccgtacgtactttcctccgtttaggaccctcccctaaaaccgttcgtaacggggaaaccaaccggacgttaccccacctacgtaccgaacccgtacgtaccggacggacccgggaccttacggactagtacggtagtacgacggtcttacgtacgttacttacgtacgtacgacggtcggacggacgaagacgacgtcgtaggtcggtcggtacggcggacgcgtacggcgtaccgtaccggtcgtacggacgacgaccgtacggaccgtcccgtcccg

SEQ ID NO: 314566 - DNA, 559 bp, Homo sapiens
  misc_feature: GZ8MTXP02H6XCK.52.4.A04.1.454.CMB.2.raw
  modified_base (168)..(168): a, c, t, g, unknown or other
  misc_feature (168)..(168): n is a, c, g, or t
  modified_base (178)..(178): a, c, t, g, unknown or other
  misc_feature (178)..(178): n is a, c, g, or t
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
tcagcgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctctatgagtgactcagacaccgtnagtgtcctcncccgagacagacagccagcatcagctgttcaggataataaaatggagataaattntggttccnggtacncgacagacgcacgctagtcgctgcctgtctatctancagaatagacgcgctacgagcctcgngagacgtactctcgtcgtacctccgtacgtacgtacgtaccgacacacactactacgactacgtacgacgaccgacgacgacgtacgtagagtagacgtacgtacgtacgttacgttacgtacgtacgtacgtacggtacggacgacgtacgtacgtacgtacgtacggtacggtacggtacggtacggacggtacgtacgtaccgtaccgtaacgtacgtacgacgaccgaccgtaccgtaccgtcccg

SEQ ID NO: 314567 - DNA, 634 bp, Homo sapiens
  misc_feature: GZ8MTXP02I7H7S.52.4.A04.1.454.CMB.2.raw
  modified_base (171)..(171): a, c, t, g, unknown or other
  misc_feature (171)..(171): n is a, c, g, or t
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (285)..(285): a, c, t, g, unknown or other
  misc_feature (285)..(285): n is a, c, g, or t
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
tcagcgcagtacgacacgaccggtgctcgatttagagtagtgatcaggggctgggcctcaggaagcagcatcggaggtgcctcagccatggcatggatccctctcttcctcctcgtccttgcttactgcacaggatgtgtggcctcctatgaggtgactcagaccaccgtnagtgtccgtctccccaggacagacagccagcatcagcttgttctaggaanaattaaaagnggaagtaattaaatattcgtttctaggtatcgacagaacgccgaggccagtccncctgtcctgtcatctancacgaataagacgccgcctgaggtactccgngagcgtattcctagtcgctccgaactcgtacgggaacacgtacgccacttaccacgaccactacggacggacccgggaacccacgggtactagtacggacgtaggacggtactagtacctttagttaccgtttaggaccgtacggtacccggtagggaaccgaaggggtaaccacgcgttacggtacggggttcggttacccggggacggggtaaaccggggccgtacgggacccgtacggtacccgttaacggacgggtaccgacccggacccgtaaccggccgtccccggtacccccgg

SEQ ID NO: 314568 - DNA, 584 bp, Homo sapiens
  misc_feature: GZ8MTXP02GI4UV.52.4.A04.1.454.CMB.2.raw
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
  modified_base (325)..(325): a, c, t, g, unknown or other
  misc_feature (325)..(325): n is a, c, g, or t
tcagcgcagtacgacacgaccggtgctcgatttagagtagtgatcaggggtgggcctcaggaagcagcatcggaggtgcctcagccatggcatggatccctctcttcctcggcgtccttgcttactgcacaggatgtgtggcctctatgaggtgactcagacaccgtcagtgtccgtctcccaggacagacagccagcatcagctgttcnggagataaaatggagataaatntgtttcnggtancgcagaagcagccagcgctgtcctggtcatctatacacgaataagaacncggccctcgagggtactccctgacgcgattcncgttggcctacctacgtccgaggggaaacctacgacgacccaacttcacgaacctactacgaacggaccgggaacccacggcctagtaggagtaggagccgtgaaacttacgttactgttaccagacccggtggaccgaagaacggctaacgtcgttacgggtgtttaccggggcggacgggaaacccgtaggtccgtacggtaacccgtccgtaaggtaccgacgacccgtaaggcccgttccgacccccgttccggg

SEQ ID NO: 314569 - DNA, 525 bp, Homo sapiens
  misc_feature: GZ8MTXP01EEZBI.41.78.H01.1.454.CMB.2.raw
  modified_base (474)..(474): a, c, t, g, unknown or other
  misc_feature (474)..(474): n is a, c, g, or t
tcagtctatactatcacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggagcacctcccaggtacagtctacatggaactgagcagcctgagatctgaggaacacggccgtgtatttctgtgcgagacgccacagcacctggcttgacttgtggggccagggaaccctgggtccaccgggtctcctcacgcctccaccaagggcccagtccgtctcccctgccnccttgccttcgaggcgccaccttcgaagacgcacacgccgcccgttgggcc

SEQ ID NO: 314570 - DNA, 557 bp, Homo sapiens
  misc_feature: GZ8MTXP01EG92A.41.78.H01.1.454.CMB.2.raw
tcagtctatactatcacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacggcttgcccagaagtccaaggcagagttagtatgaccaggagcacctccccaggtacagtctacatggaactgagcagcctgagatctgaggaacacggccgtgtattctgtgcgagacgccaccagcactggcttgacttggtcggggccagggaaccctggtccaccgggtctcctcacgccctccaccgtaacgggcccctacgtccggttcccttcccccgtgggcccgtcccttgcccttccgacggacgccgccttccgaagacgccgacgacggccggtcccgttggggtccg

SEQ ID NO: 314571 - DNA, 536 bp, Homo sapiens
  misc_feature: GZ8MTXP01DOTDI.41.78.H01.1.454.CMB.2.raw
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
tcagtctatactatcacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagtccaaggcagagttagtatgaccaggagcacctccccaggtacagtctacatggaactgagcagcctgagatctgaggaacacggccgtgtatttctgtgcgagagccacagcacctggcttgacttggtcggggccagggaaccctgggtccaccgggtctcctcacgccctccaccgaacgggcccagtccggtcctccccgtggccgcccttgccttcgaggcnccnccttccgaagacgcacgcggccgccgttgggcc

SEQ ID NO: 314572 - DNA, 552 bp, Homo sapiens
  misc_feature: GZ8MTXP01ARSZU.41.78.H01.1.454.CMB.2.raw
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
tcagtctatactatcacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggctttgcccagaagttccaaggcagagtagtatgaccaggacgcaccctccccaggtacagtctacagtggaactgagcagcctgagatcgtgacggacacggccgtgtatttctgtgcgagacgccacagcaccgtggcttggacttgggcggggccacgggggaccctgggtccaccgtctcctcacgccctaccgaccgaacgggcccctagtcccggtccctccccgtggccctccctgcctccgaaggcnccacccttcgacgcncgcgcggccggccctggggctcggccgtggttccgaacgg

SEQ ID NO: 314573 - DNA, 695 bp, Homo sapiens
  misc_feature: GZ8MTXP01ATT0Q.41.78.H01.1.454.CMB.2.raw
tcagtctatactatcacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaaggctggagtggatgggatggatgaagcctatagtgcaacgacgggtcttgcccagaagtccaaggcagagtagatgaccaggacgcacctccccaggtacagtactacagtacggaactgacgcacgcctgagatcgtaggaccggacacgggtccgttagttacttttacgtgtcgcggaagacggacccaccgacgccaccgtcggtcttggacgttgggtacggggacccgtaacgggggtaaccccgttgggtaccctacccggttcctcccgtaccgaccggaccccttacccgaacccggtaaaccggggtccccgtaacggtttccccgggtcccgtttcccccccgtcgggggcccctccccgttcggcccgttcccggaacgggaccgacccgaccccgttccgggaacgacgttacccgaccggacccgggccccggggtccccgtcgggggtccctcggttccccggttgggttaacccgtaaaccggg

SEQ ID NO: 314574 - DNA, 587 bp, Homo sapiens
  misc_feature: GZ8MTXP01ALS27.41.78.H01.1.454.CMB.2.raw
  modified_base (346)..(346): a, c, t, g, unknown or other
  misc_feature (346)..(346): n is a, c, g, or t
tcagtctatactatcacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagtagatgaccaggagcacctccccaggtacagtctacatgaactgagcagcctgagatctgacgacacggcgtgtattcngtgcgagagccaccagcaccgtggtcttgacgttggcggggccaacggggacccctgggtcccacccggtctcccgtacgacgccccgtcccgaacccgtaacgggcccctaacgtcccggttcccttccccccgtgggccccgtccccgtcgcccgtcccgaacgggcgcccgacccttcccggagacgccaccgacggcccggtcccgtcggggcctcggccctcgggcctaaaccggg

SEQ ID NO: 314575 - DNA, 627 bp, Homo sapiens
  misc_feature: GZ8MTXP01DBW5I.41.78.H01.1.454.CMB.2.raw
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (374)..(374): a, c, t, g, unknown or other
  misc_feature (374)..(374): n is a, c, g, or t
tcagtctatactatcacgaccggtgctcgatttagtgtgagtagtttgggtttggggctgggcctcaggaagcagcatcggaggtgcctcagccatggcatggatccctctcttcctcggcgtcccttgcttactgcacgagggtccgggcctcctctgacctgactcagccatcctcactcgtccgtgtccccaggacacacagtcactattacctgctcgtaggggaaaacttggagtgaattaaatttgcttcctaggtatcagcagaggcaggccagccccatgctgtcatcttacaggataataacgcggcctcgagggactccngacggcnttccgtctcggctaccaaactcgtaacggggaaaccnccggactacctacgacgaccatcgacgccgaccgactacgtcctgtaggatcggagtcgtacgtaactacttaacgtacgtacgggtaacggtaacggtaaacgggtaaaggtacgtaacgttaaggttagggttacgggtacgggtacgggaacgggtaaccgaacgtaacgtacggttccggttccgttacgtacgtacgaccgacgttacgtccgtcccgtccgtcgtcgttccgtccgttcccgtcccg

SEQ ID NO: 314576 - DNA, 536 bp, Homo sapiens
  misc_feature: GZ8MTXP02HQGMP.41.78.H01.1.454.CMB.2.raw
tcagtctatactatcacgaccggtgctcgatttagtgtgagtagtttgggtttgggggaagaggaagactgacggtcccactcccaggtacagctggtgcagtctggggctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacacgggctttgcccagaagttccaaaggcagagttagtatgaccaggagcacctccccaggtacagtctacatggaactgagcagcctgagatctgaggacacggccgtgtatttctgtgcgagagccacagcacctggcttgacttggcggggccagggaaccctggtccaccggtctcctcacgccctccaccgaacgggccccagtccggtccttcccccgtggccgcccctgcctccgacggacgccacctccgaagacgcacagcccggcctggccg

SEQ ID NO: 314577 - DNA, 572 bp, Homo sapiens
  misc_feature: GZ8MTXP02FW0EY.41.78.H01.1.454.CMB.2.raw
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
tcagtctatactatcacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggaaagccgtggggagtcccttagactctcctgtgcagcctctggattcactttcagtaacgcctggatgacctgggtccncaggcncgagggaggctggagtgggtgcgtatagaaccaaagctaggacggtggacagcagactacgccgcgacccgtaggaaaggccagactcaccatctacaagagatagaatacaaaagaagtacgtagtctctagacagatacgaacagcctagaacaccgagacacgacgccgtactagttactgtacgtagggtagttcggttctaacggtccggggtaccgtaacggggtaaccccgtcgtaccgacccgtctcccg

SEQ ID NO: 314578 - DNA, 536 bp, Homo sapiens
  misc_feature: GZ8MTXP02FU9BX.41.78.H01.1.454.CMB.2.raw
  modified_base (347)..(347): a, c, t, g, unknown or other
  misc_feature (347)..(347): n is a, c, g, or t
  modified_base (456)..(456): a, c, t, g, unknown or other
  misc_feature (456)..(456): n is a, c, g, or t
tcagtctatactatcacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagcctatagtggcaacacgggctttgcccagaagttccaaggcagagtagtatgaccaggagcacctccccaggtacagtctacatggaactgagcagcctgagatctgagacacggcgtgtattcngtgcgagagccacagcacctggcttgacttggcggggcaacgggaccctggtcaccgtctcctcacgccctccaaccgaacgggcccctagtcccggtccttcccccgnggcccgccctgcctccgacggacgccacctccgagacgcacgacgccggcccgtggggctcgcccgtggtaccaaaacgg

SEQ ID NO: 314579 - DNA, 549 bp, Homo sapiens
  misc_feature: GZ8MTXP02JS4WN.41.78.H01.1.454.CMB.2.raw
  modified_base (413)..(413): a, c, t, g, unknown or other
  misc_feature (413)..(413): n is a, c, g, or t
tcagtctatactatcacgaccggtgctcgatttagtgtgagtagtttgggtttggggagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtccgccaggctccgagggaggggctggagtgggttggccgtattagaaccaaagctgacggtgggacagcagactacgctgcacccgtgaaaggcagattcaccatcnaagagatgattacaaaagatacggtgtactctgcagatagaacagccctagaaccacgaggacacgagccgtactattactgtctgggtattggttcaagttcgggaccgacggggaaccctcggtaccaccgtcc

SEQ ID NO: 314580 - DNA, 603 bp, Homo sapiens
  misc_feature: GZ8MTXP02H8F2M.41.78.H01.1.454.CMB.2.raw
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
  modified_base (504)..(504): a, c, t, g, unknown or other
  misc_feature (504)..(504): n is a, c, g, or t
  modified_base (532)..(532): a, c, t, g, unknown or other
  misc_feature (532)..(532): n is a, c, g, or t
tcagtctatactatcacgaccggtgctcgatttagtgtgagtagtttgggtttgggtgccgaagttgctggaggtcacggtcaccacgctgctgaggtgaagaagcctggggcctcagtgacagtctcctgcacggcttctggatacacgttcatcaattatgatattaactgggtgcgacaggccgctggacaagggctggagtggatgggatggatgaagccctatagtggcaacgacgggtctttgacccaagaagttccaaggcagagttagatgaccaggagcacctccccgaggtacagtctacataggaactgagcagcctagagatcgtgacggacacggtccgtgttactttcgngtgcgagacgaccaccncgcacctgggccttaggaccgtttgggacgggggccctaacggggtacccctgggtcccacccgttctccacgaccgtccctacccgaaccgacgggcccctagttcccggtccttcccccgnggccctcccgtgccctaccgacggaccncccgacccgtacggacgaccgccgtacgccggtcccggtccgtcgggcctcggaccgtacggtaccgaacg

SEQ ID NO: 314581 - DNA, 689 bp, Homo sapiens
  misc_feature: GZ8MTXP02JTH3F.41.78.H01.1.454.CMB.2.raw
tcagtctatactatcacgaccggtgctcgatttagtgtgagtagtttgggtttggggctgggcctcaggaagcagcatcggaggtgcctcagccatggcatggatccctctcttcctcggcgtccttgcttactgcacgaggggtccgggcctcctctgacctgactcagccatcctcactcgtccgtcgtcccaggaccacacagtcactattacctgcgtcgtaggggaaacttgagtagtaattaatttgcttcgtggtatcagcaggacggccacggccacgccccctagtcgcgtggtctatcttagagtataagtacggccgccgcgacgggtactccgtgacgccgtcgttctcctacgtacctacctaacgtacgtacggaaccgaccggtccctaactccgtacgacctacgtaccacggccgacccgacccacgtccgtcgtaggacgtcggacgtacgtacgtacttaacttaccgtaggtacgaacgggtaaggtacgggaaacggttacgtacgttaaggttcggggttcgggtacggggtacggggtaacggtaaccggaacggtacggtacggtaccggttaccggtacggtaccggaccgacccggtaaccggccgtccccgtccccggttacggtcccgtaccgttcccgttccggttacccccttaccccg

SEQ ID NO: 314582 - DNA, 528 bp, Homo sapiens
  misc_feature: GZ8MTXP01B2AUT.11.21.B10.1.454.CMB.2.raw
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctctcctgcagggccagtcagagtgttaacagctacttagcctggtaccaanagaaacctggccagactcccaggctcctcatctatgatgcatccaacagggccactggccacccagccaggttcagtgccaggtgggtctgggacaagacttcactctcaccatcagcagcctagagctgaggtattttgctagtttatactgtcagcagtcgtatcgactggactctaccgttcggacccaaagggaccaacgtaactaaggaaaacttaaacgacgtagtggacttgaccaacatctgtcttctaacttccttcccg

SEQ ID NO: 314583 - DNA, 539 bp, Homo sapiens
  misc_feature: GZ8MTXP01EYZWX.11.21.B10.1.454.CMB.2.raw
  modified_base (303)..(303): a, c, t, g, unknown or other
  misc_feature (303)..(303): n is a, c, g, or t
  modified_base (365)..(365): a, c, t, g, unknown or other
  misc_feature (365)..(365): n is a, c, g, or t
  modified_base (505)..(505): a, c, t, g, unknown or other
  misc_feature (505)..(505): n is a, c, g, or t
tcagcgagagataccacgaccggtgctcgatttagtgtcgtcgcaagagaggaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccctggggacgtccctgagactctcctgtacagcctctggcttcaccttcatacctatggcatgcacgtgggtcccncagacctccgaggcgagggggctgggaggtgggtggctagttattcatatgatggaaatgtnacttctattcagtactccggtagaacggggccgattcaccgtctccagagacaattccagcacacgctgtagtctgacaaatgaacagcctagagagcgtgaaggaacacggctgttgtattacttgttcgagtaaagtntttctaagttagacggtgttaacggtaacggggg

SEQ ID NO: 314584 - DNA, 505 bp, Homo sapiens
  misc_feature: GZ8MTXP01EGIZ9.11.21.B10.1.454.CMB.2.raw
  modified_base (198)..(198): a, c, t, g, unknown or other
  misc_feature (198)..(198): n is a, c, g, or t
tcagcgagagataccacgaccggtgctcgatttagtgtcgtcgcaaggagaggggaggaactgctcagttaggacccagagggaaccatggaagccccagctcagcttctcttcctcctgctactctggctccagatagcaccggagaaattgtgttgacacagtctccagccaccctgtctttgtctccagggaaangccacctctcctgcagggccagtcagagtgttaacagctacttagcctggtaccaacagaaacctggccagactcccaggctcctcatctatgatgcatccaacagggccactggccaccccagccaggttcagtggccaggtggtctgggacaagacttcactctcaccatcagcagcctagagcctgaggattttgctagtttatactgtcagcagcgtatcgactggatcaccttcggccaagggcacgaactggaaattaaacgatagtggcttgctaaccatctgtcttctaattcttcccg

SEQ ID NO: 314585 - DNA, 502 bp, Homo sapiens
  misc_feature: GZ8MTXP01CQ2AU.11.21.B10.1.454.CMB.2.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (360)..(360): a, c, t, g, unknown or other
  misc_feature (360)..(360): n is a, c, g, or t
tcagcgagagataccacgaccggtgctcgatttagtgtcgtcgcaaggagaggggaggaactgctcagttaggacccagagggaaccatggaagccccagctcagcttctcttcctcctgctactctggctccagatagcaccggagaaattgtgttgacacagtctccagccaccctgtctttgtctccgagggaaanagccaccctctcctgcagggccagtcagagtgttaacngctacttagcctgggtaccaaacagaaacctggccagacncccaggctcncatctatgatgcatccaaacaggccactgcaccccagccaggttcagtgccaggtggtctgggacaagacttnactctcaccatcagcagcctagagctgaggtatttgctagtttatactgtcagcagcgtatcgactggatcacttcggcaagggcacgaactaggaaattaaacgacgtagtgcttgacaacatctgtcttcaattctcccg

SEQ ID NO: 314586 - DNA, 518 bp, Homo sapiens
  misc_feature: GZ8MTXP01BCLOM.11.21.B10.1.454.CMB.2.raw
  modified_base (259)..(259): a, c, t, g, unknown or other
  misc_feature (259)..(259): n is a, c, g, or t
  modified_base (298)..(298): a, c, t, g, unknown or other
  misc_feature (298)..(298): n is a, c, g, or t
  modified_base (476)..(476): a, c, t, g, unknown or other
  misc_feature (476)..(476): n is a, c, g, or t
  modified_base (490)..(490): a, c, t, g, unknown or other
  misc_feature (490)..(490): n is a, c, g, or t
tcagcgagagataccacgaccggtgctcgatttagtgtcgtcgcaagagaggaggggggagaggagcccagcactagaagtcggcggtgtttccattcggtgatcagcactgaacacagaggactcaccatggagtttgggctgagcgtgggttttcctcgttgctctttaagaggtgtccagtgtcaggtgcaactggaggagtcgtgggggagcgtggtccagcctgggagtccctgagactctcctgtacagcctntggcttcaccttcatacctatggcatgcactgggtcccnccagactccaggcagggggctgggagtggggtggcagttattcatatgatggaaatgtgacttctattcagtactcgtgaagggccgatcacgtctccagagacaattccaggcacacgctgtatctgacaaatgaacagcctagagagctggaggaacgacggctgttgtattacgngttgacgaaagttnttaagtagtaggaggtcgaacggtcggg

SEQ ID NO: 314587 - DNA, 522 bp, Homo sapiens
  misc_feature: GZ8MTXP01D1TIP.11.21.B10.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtagttaacagctacttagcctaggtaccaaanagaaacctggccagactcccaggctcctnatctatgatgcatccaacagggccactggccaccccgagccaggttcagtggccaggtgggtctgggacaagcttcactctacacatcagcagcctagacgctgaggtatttgctagtttattactgtacagcagtcgtatcgacgtggactccgaccgttcggaccaagggacacgaactagaaattaaacgactgtgcttgacaacatctgtcttactcttccttccg

SEQ ID NO: 314588 - DNA, 512 bp, Homo sapiens
  misc_feature: GZ8MTXP01CIBMI.11.21.B10.1.454.CMB.2.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctctcctgcagggccagtcagagtgttaacngctacttagcctggtaactaacagaaacctggccagactcccaggctcctcatctatgatgcatccaaacagggccactggccaccccagccaggttcagtggccaggtggtctgggacaagacttcactctcacatcagcagctagagctgaggtatttgctagtttattactgtcagtcagtcgtatcgactggatcaccgttcgccaagggcacgaactaggaaattaaacgacgtagtggcttgcaacatctgtcttcaacttcgttccc

SEQ ID NO: 314589 - DNA, 524 bp, Homo sapiens
  misc_feature: GZ8MTXP01D8NWZ.11.21.B10.1.454.CMB.2.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaanagccaccctntcctgcagggccagtcagagttgttaacagctacttagcctggtaacccaaanagaaacctggccagacncccaggctccncatctatgatgcatccaacagggccactggcccaccccagccaggttcagtgccagtgggtctgggacaagacttcactctcaccatcagcagctagagctgagtattttgctagtttatactgtcagcgaagtcgtatcgacgtggatccaaccttcggaccaagggacacgaactaggaaattaaacggatgtggcttgcaacctatctgtcttctaacttccgttaaccc

SEQ ID NO: 314590 - DNA, 576 bp, Homo sapiens
  misc_feature: GZ8MTXP01BB1XB.11.21.B10.1.454.CMB.2.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
  modified_base (403)..(403): a, c, t, g, unknown or other
  misc_feature (403)..(403): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctccagatagcaccggagaaattgtgttgacacagtctccagccacctgtctttgtctccaggggaangccacctntcctgcagggccagtcagagtgttaacagctacttagcctaggtaaccaanagaaacctggccagactcccaggctcctnatctatgatgcatccaacgacgggccacgtggacccaccccagccaggttcagtcggccaggtgggtctgggacaagtacttcactctacaccatcagcagcctagacgcctgagtnttttgacttagtttactactgttacacggcaaggtcgttaatccggtactggacttccgaacccgttcgggacccgtaaagggccgaaacgaacgttaaggaaaactttaaacggacgttggtacggcttggacctaaccgtatcttagtccttcgtaactttcctaaccccg

SEQ ID NO: 314591 - DNA, 526 bp, Homo sapiens
  misc_feature: GZ8MTXP01BMYFF.11.21.B10.1.454.CMB.2.raw
  modified_base (202)..(202): a, c, t, g, unknown or other
  misc_feature (202)..(202): n is a, c, g, or t
  modified_base (327)..(327): a, c, t, g, unknown or other
  misc_feature (327)..(327): n is a, c, g, or t
  modified_base (370)..(370): a, c, t, g, unknown or other
  misc_feature (370)..(370): n is a, c, g, or t
  modified_base (502)..(502): a, c, t, g, unknown or other
  misc_feature (502)..(502): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggccagactccccaggctcctcatctatgatgcatccaacagggccactggccacccngccaggttcagtggccaggtggtctgggacaagacttcactcncaccatcagcagctagagcctgagtatttgctagtttattactgtactagcgtagcgtatcgatggatctaccgttcgacctaagggacacgaactaggaaattaaacgaacgtgtaggcgttgactaaccntctgtcttctaacttccttccccg

SEQ ID NO: 314592 - DNA, 812 bp, Homo sapiens
  misc_feature: GZ8MTXP01AL6PY.11.21.B10.1.454.CMB.2.raw
  modified_base (203)..(203): a, c, t, g, unknown or other
  misc_feature (203)..(203): n is a, c, g, or t
tcagcgagagataccacgaccggtgctcgatttagtgtcgtcgcaaggaggaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaangccaccctctcctgcagggccagtcagagtgttaacagctacttagcctaggtaaccaacagaaacctggccagacctccaggcctcctcatctatgatgacactacccaaacgacgggacccacgtcggacccaacccccgaggaccccgtagggtttccaagggttcgggaccccgtaggggttcgggggttccgtaggggggaacctaaacgggttaacccttttccgaccctttaccctacccgaaaccccctaattacccgaaggtacccaacggtacccgttaacggaacggtccccgttagggtaaacggggtttaacttttttacgggaacctttaagggtttttaaactttacgttacgggtttacaacgggtaccggtaacgggttacccggtttaaagttcccgggtaacgttcggggtaacctttcccgtaaacccgggtttccggggaacccggtaaaacgggggaccctaaaccgggtaaacgttaacggggttaaaaactttaaaaccgggaaccgtttaggggttacggttcgttcggaccctaacctacttccgttacggtttcctttacctaacctttccccgtttccccg

SEQ ID NO: 314593 - DNA, 570 bp, Homo sapiens
  misc_feature: GZ8MTXP01EMM5N.11.21.B10.1.454.CMB.2.raw
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctggggaggtccctgagactctcctgtacagcctctggcttcaccttcatacctatggcatgcactgggtccgccagactccaggcgaggggggctggaggtgggtggcagttatttcatatgatggaaatgtagacttctattcacgtaccgtcgtagggacggcgtactccgaccgtcaccagacactactccgacgcacacgctgtcgtctcacacacacgacgacgacgcgtgacgacgacggaacggacgacggtacgttacgttacgttacgttacgttcgttacgtaagtacgtaacgttacgttacgttacgtaacggttaacgggtaacggg

SEQ ID NO: 314594 - DNA, 557 bp, Homo sapiens
  misc_feature: GZ8MTXP01DTCDC.11.21.B10.1.454.CMB.2.raw
  modified_base (260)..(260): a, c, t, g, unknown or other
  misc_feature (260)..(260): n is a, c, g, or t
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
  modified_base (468)..(468): a, c, t, g, unknown or other
  misc_feature (468)..(468): n is a, c, g, or t
  modified_base (486)..(486): a, c, t, g, unknown or other
  misc_feature (486)..(486): n is a, c, g, or t
tcagcgagagataccacgaccggtgctcgatttagtgtcgtcgcaagagaggaggggggggagaggagcccagcactagaagtcggcggtgtttccattcggtgatcagcactgaacgcagaggactcaccatggagtttgggctgagtcttgggttttcctcgttgcttcttttaagaggtgtccagtgtcaggtgcaacgtggaggagtcgtgggggagcgtggtccagccgtgggagtccctgagctctcctgtacngcctctggcttcaccttcatacctatggcatgcacgtgggtcccncagacctccgaggcgagggggctgggagtgggngctagttattcatangatggaaatgtatactttcattcagtacctccggtaggaaacgggccgtattccaccgtctaccaagacgaactacttaccaggaccacacgctagtactctagacaaatgaacngctagagagctgagaacncgctgttagtattagttgttagacgtaaagtatttaacgtagtaggttagggtcgaacggttaaccggggg

SEQ ID NO: 314595 - DNA, 502 bp, Homo sapiens
  misc_feature: GZ8MTXP01D0RX9.11.21.B10.1.454.CMB.2.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (260)..(260): a, c, t, g, unknown or other
  misc_feature (260)..(260): n is a, c, g, or t
  modified_base (482)..(482): a, c, t, g, unknown or other
  misc_feature (482)..(482): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctntcctgcagggccagtcagagtgttaacagctacttagcctggtaccaanagaaacctggccagactcccaggctcctcatctatgatgcatccaacagggccactggcaccccagccagtcagtgcagtggctgggacagacttcactctcaccatcagcagcctagagcctgaggtattttgctagtttattactgtacagcgagtcgtatcgatggatcaccttgccaagggcacgaactaggaaattaacgaagtgtgcttgcaaccntctgtcttatcttcttcccg

SEQ ID NO: 314596 - DNA, 523 bp, Homo sapiens
  misc_feature: GZ8MTXP01BB283.11.21.B10.1.454.CMB.2.raw
  modified_base (201)..(201): a, c, t, g, unknown or other
  misc_feature (201)..(201): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
  modified_base (513)..(513): a, c, t, g, unknown or other
  misc_feature (513)..(513): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggcagactccagctcncatctatgatgcatccaacnggccactggcaccccagccaggttcagtggccaggtgggtctggggacaagaccttcactctcacatcagcagcctagacgcctgaggtacttttgctagtttattactgtcagtcgagtcgttactcgacttggatcctaccgttcggaccaagggacacgaacgtaggaaattaaacgacgtgtagcgttgacaacatctgtcttcncttcctcccg

SEQ ID NO: 314597 - DNA, 657 bp, Homo sapiens
  misc_feature: GZ8MTXP01AKHR3.11.21.B10.1.454.CMB.2.raw
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctccagatagcaccggagaaattgtgttgacacagtctccagccaccctgtctttgtctccgaggggaanagccacctctcctgcagggccagtcagagtgttaacagtctacttagcctaggtaaccaaacacgaaacctggaccagactcccgaggctcctcatctatgatgcatccaacgngggccacgtcggcccaccccgagccgtaggttcaggtggccgaggtgggtcgtacgggacaagtacttcactacctcaccatacagcacgccgtaagacgccgttaggtaggttacgttttgtacttaacggttttatttaaccgtgttacgacgcggtaacggtcgttactacggtacgtcggtacttacccgtacccgttccgggtaacccgaaaggggacctaacggtaaacggttaaacggaaaactttaaaccggttaacgtcggttaacgggttccgttacgaccctaactaccttcgtttacgttaccgttacctaacgtttccccttaaccccg

SEQ ID NO: 314598 - DNA, 538 bp, Homo sapiens
  misc_feature: GZ8MTXP01EHIIU.11.21.B10.1.454.CMB.2.raw
  modified_base (202)..(202): a, c, t, g, unknown or other
  misc_feature (202)..(202): n is a, c, g, or t
  modified_base (278)..(278): a, c, t, g, unknown or other
  misc_feature (278)..(278): n is a, c, g, or t
  modified_base (518)..(518): a, c, t, g, unknown or other
  misc_feature (518)..(518): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgtaacagctacttagcctggtaccaacagaaacctggccagaccnccaggctcctcatctatgatgcatccaacgacgggccacgtcggcccaacccccgagccctaggttcaggtcggccaggtgggtctggggacaagacttcactctcaccatcagcacgctagacgctgaggtatttgctagtttattactgtcagcgagtcgtatcgagtggactccgtaccttcggaccaagggacacggaactaaggaaattaaacgaacgtggtgcttcgacaactntctgtcttctcttccgtccc

SEQ ID NO: 314599 - DNA, 596 bp, Homo sapiens
  misc_feature: GZ8MTXP01EXC04.11.21.B10.1.454.CMB.2.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccacctgtctttgtctccgaggggaaanacgccaccctctcctgcagggccagtcagagtgttaacagctacttagcctaggtaaccaaacagaaacctggccagactcccagctcctnatctatgatgcatcccaaacgacgggcccacgtcggacccaacccccgagccctaaggttccaaggttcggcccctagggttcgggggtctagggggaaccaaacggtacctttccaacttcctacccaacctactcaggccagtccctaggacgtcctaggaggttattttcggactagttttatactgtacagcgagtcgtatcgactggactcgacccttcgggacctaagggaccacggaacgtaaggaaactaaacgactggtggcttgccaactatctgtcttctaacttccgtccc

SEQ ID NO: 314600 - DNA, 716 bp, Homo sapiens
  misc_feature: GZ8MTXP01BPXXV.11.21.B10.1.454.CMB.2.raw
  modified_base (672)..(672): a, c, t, g, unknown or other
  misc_feature (672)..(672): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagcccaccctgttctttgtctccgaaggggaaagacgcccaccctctcctgcagggccagtcagagtagttaacagcttaactagcctaggtaaccaaacagaaacctggaccagacctccaggcctcctcatctatgatgacactccaaacgcgggacccacgtcggacccaacccccgaggccccgtaagggtttccaggttcgggacccgtagggttcgggggtctagggggaacctaacggtaacctttcgaccttcctaccaacccctatcgagccagacctaggacgtccgtaggtaggttacttttggacttaagttttactacgttgtactaggctaggtccgttagtcccgtaagttcgggtaccttaccggttaacccgttccggggaaaccccgaaagggggtaaccctaaccgggtaaacgttaaacggggttaaaaactttaaaacccgggaacgttggggtaccggcttcggacctaaacccgttnttcgtttacgttcctttaccgttaaccgtttccccgtaaccccg

SEQ ID NO: 314601 - DNA, 563 bp, Homo sapiens
  misc_feature: GZ8MTXP01EGTRL.11.21.B10.1.454.CMB.2.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (358)..(358): a, c, t, g, unknown or other
  misc_feature (358)..(358): n is a, c, g, or t
  modified_base (403)..(403): a, c, t, g, unknown or other
  misc_feature (403)..(403): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctntcctgcagggccagtcagagtgttaacngctacttagcctggtaccaanagaaacctggcagacnccagctcnatctatgatgcatccaacaggccactggccacccagccaggttcagtgcaggtggtctgggacagacttcactcncacatcagcagctagcgctgaggtatttgctagtttatactgtanagcgagtcgttatcgactggactcgaaccgtttcggacccgaaaggggccaacggtaacgtagggttaaaatttaaaaccggttaaacgtaggtagggttaccttgaccctaaaccctattcccttgttcctttacctaacgtttcccgtttaacccccg

SEQ ID NO: 314602 - DNA, 585 bp, Homo sapiens
  misc_feature: GZ8MTXP01EV68C.11.21.B10.1.454.CMB.2.raw
  modified_base (258)..(259): a, c, t, g, unknown or other
  misc_feature (258)..(259): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (274)..(275): a, c, t, g, unknown or other
  misc_feature (274)..(275): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcaactggaggagtcgtgggggagcgtggtccagccgtgggagtccctgagctctctgtacnnctngctcnctnatcnngcntgcncgtcggccncagacncgagcgngggctggnggtggtgntagttatnatntagtatagtaatgtatacttctatcacgtacgtcggtaggacggcctactccgaccgtctacgagacgtaacacgtacgacgacacgacgtacgtagtacgtctacgaactaacgtacgaacgacgcgtaggacgtacgtacgacggaacggaacgtacggttcgttcgttagttaacgtttcccaagttcgttaacgtaagttaagttaacgttaggtaaggttacggggtaaccgggttaacgggtaacggg

SEQ ID NO: 314603 - DNA, 586 bp, Homo sapiens
  misc_feature: GZ8MTXP01A22AQ.11.21.B10.1.454.CMB.2.raw
  modified_base (305)..(305): a, c, t, g, unknown or other
  misc_feature (305)..(305): n is a, c, g, or t
  modified_base (370)..(370): a, c, t, g, unknown or other
  misc_feature (370)..(370): n is a, c, g, or t
  modified_base (474)..(474): a, c, t, g, unknown or other
  misc_feature (474)..(474): n is a, c, g, or t
  modified_base (482)..(482): a, c, t, g, unknown or other
  misc_feature (482)..(482): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacgtccctgagactctcctgtacagcctctggcttcaccttcataccatcggcatgcacgtcgggtccnccagacctccgaggcgagggggctgggagtgggggtgctagttattcatatgataggaaatggtntactttcgtattcagtactccggtagaaacgggcctattcaccgtctccgaagtacgaactaacttccgaggccacgacgtctagtatcgtagacaaatgaacngccgtagngtacgcgtgacggaacgacggttctaggttagttatttacgttggttcggaacgtaaagtatttaacgtaagtaggttaggtaacggaacgggttaaccggggg

SEQ ID NO: 314604 - DNA, 549 bp, Homo sapiens
  misc_feature: GZ8MTXP01A8GER.11.21.B10.1.454.CMB.2.raw
  modified_base (265)..(265): a, c, t, g, unknown or other
  misc_feature (265)..(265): n is a, c, g, or t
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
  modified_base (465)..(465): a, c, t, g, unknown or other
  misc_feature (465)..(465): n is a, c, g, or t
tcagcgagagataccacgaccggtgctcgatttagtgtcgtcgcaagagaggaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagccgtgggacgtccctgagactctcctgtacagcctntggcttcaccttcatacctatggcatgcacgtgggtccnccagacctccaggcgagggggctggagtgggtgctagttattcatatgataggaaatgtanacttctattcagtacctccggtagaaacgggtccctattccaaccggtctaccgagacgactaattccaggcacacgctgtactctagacaaagtgaacngcctagagagctgaggaacacggctgttgtattacgttgttgacgtaaagtctttaatagtaggaggtgaacggttaacggggg

SEQ ID NO: 314605 - DNA, 737 bp, Homo sapiens
  misc_feature: GZ8MTXP01D9Y5T.11.21.B10.1.454.CMB.2.raw
  modified_base (261)..(261): a, c, t, g, unknown or other
  misc_feature (261)..(261): n is a, c, g, or t
tcagcgagagataccacgaccggtgctcgatttagtgtcgtcgcaagagaggagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtgggacgtcccgagactctctcgtacacnctcctgcgtcctacctctatactactgcgctagtcgactacgggtccggcccacgacgtaccacggacggacgggggagggtcggtagggtcggggttgggacgtacgtttaagttttactatagttacgagttaggtaaagtaaagttgtaacttcttaagttactaacgacgttacccgtgggaacgggaccgggtactctaccgtaccttaccgacgaaaggactaaaccttactaccggacgtaccaaaccgtccgtagttaacgttacttaccgaataaaacgttaaacgaaaccgaacgtacccgttaggaaaggacggtaccgttagggtaacgggaacgaaacccgggtcggttaggttacggtttaattaaaccggtttcggttaaggttccggttaaaaacgttaagttttaccttaagtaagggtacgggttaggttaacccgggttaacgggggttttcccggg

SEQ ID NO: 314606 - DNA, 550 bp, Homo sapiens
  misc_feature: GZ8MTXP01D7J7F.11.21.B10.1.454.CMB.2.raw
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
  modified_base (493)..(493): a, c, t, g, unknown or other
  misc_feature (493)..(493): n is a, c, g, or t
  modified_base (504)..(504): a, c, t, g, unknown or other
  misc_feature (504)..(504): n is a, c, g, or t
  modified_base (519)..(519): a, c, t, g, unknown or other
  misc_feature (519)..(519): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcaacgtggaggagtcgtgggggagcgtggtccgccgtgggacgtcctgagactctcctgtacngtcctctggcttcaccttnatacctagtggcatgcacgtgggtcccncagactccgaggcgagggggctggagtgggtgctagttattcatatgataggaaatgtgtacttcgtattccagtactccggtaggaacgggcccgtattcaccgtctaccagacgaactaacttccaggcacgactctagtactctagacaaatgaaacngcgtagagagtcnggagaactacgntgttagtactnttgttgacgtaagtntttaacagtagaggtgaacggttaacggggg

SEQ ID NO: 314607 - DNA, 558 bp, Homo sapiens
  misc_feature: GZ8MTXP01AKS64.11.21.B10.1.454.CMB.2.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgctccaggggaaanagccaccctntcctgcagggccagtcagagtgttaaacagctacttagcctggtaccaacagaaacctggccagactcccaggctcctcatctatgatgcatcaacaggcactgcacccagccaggtcagtgccagtggtctggacgaagacttcactctcaccaatacacgcacgacgtacgacgacgtagtaggtagtttgtactagtttattactagtacgtacgacgagacgtactacgtacgtgtacgtcgtaccgttcggtaccgaacggaacgaacgaacgtaacggttaaagtaaacgaaacgtagtaggttcgttcgcaaccactctcgtcttactaacgttcgttccg

SEQ ID NO: 314608 - DNA, 548 bp, Homo sapiens
  misc_feature: GZ8MTXP01DR6PE.11.21.B10.1.454.CMB.2.raw
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
tcagcgagagataccacgaccggtgctcgatttagtgtcgtcgcaaggaggagggggggaggaactgctcagttaggacccagagggaaccatggaagccccagctcagcttctcttcctcctgctactctggctccagatagcaccggagaaattgtgttgacacagtctccagccacctgttctttgtctccgaaggggaaagacgccaccctctcctgcagggccagtcagagtgttaacngctattagcctaggtaaccaaanagaaacctggccagacnccagctctcatctatgatgcatccaaagacgggccacgtcggaccaaccccagcctaggttcaggtcggaccaggtgggtctgggacaagtacttcactctacacatcagcagctagacgctgagtatttgactagtttatacgtgtacagcgagcgttatcgactggactcgaccgttcggaccgaaagggacaaggaactaaggaaaacttaaacgacgtggtcgcttcgaccaactatcctagtcttcaacttccgtcccg

SEQ ID NO: 314609 - DNA, 660 bp, Homo sapiens
  misc_feature: GZ8MTXP01BLKE6.11.21.B10.1.454.CMB.2.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacngctacttagcctggtaccaanagaaacctggccagacctcccaggctcctcatctatgatgcatccaacgacgggccacgtcggcccaccccgagcccgtaggttcaggtcggcccaggtcggggtctggggactaaggtaccttcgactcctcacctatcagcacgcctagacgctggagttactttgacttagtttatactgttacacgcgtacgtcgttataccgtaacgtcggtactcccgtaacccggtttcgggacccgtaaaacgggggaccctaaacccgggtaaagttaacggggaaaaacctttttaaaaccgggaaccgtttaagggtccggggttaccttcggacccctaaaccccgtttcttaaccgtttccgttacctttaccgttaacccgtttccccgtccccg

SEQ ID NO: 314610 - DNA, 551 bp, Homo sapiens
  misc_feature: GZ8MTXP01A826H.11.21.B10.1.454.CMB.2.raw
  modified_base (257)..(257): a, c, t, g, unknown or other
  misc_feature (257)..(257): n is a, c, g, or t
  modified_base (302)..(302): a, c, t, g, unknown or other
  misc_feature (302)..(302): n is a, c, g, or t
  modified_base (368)..(368): a, c, t, g, unknown or other
  misc_feature (368)..(368): n is a, c, g, or t
  modified_base (456)..(456): a, c, t, g, unknown or other
  misc_feature (456)..(456): n is a, c, g, or t
  modified_base (465)..(465): a, c, t, g, unknown or other
  misc_feature (465)..(465): n is a, c, g, or t
  modified_base (514)..(514): a, c, t, g, unknown or other
  misc_feature (514)..(514): n is a, c, g, or t
tcagcgagagataccacgaccggtgctcgatttagtgtcgtcgcaagagaggagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagctctcctgtacngcctctggcttcaccttcatacctatggcatgcacgtgggtcccnccagacctccgaggcagggggctgggagtgggtgctagttattcatatgatggaaatgtagacttntattcagtacctccggtagaacgggcctattccaccgtctccagagactaattccaggcacacgctagtatctagacaaatcgaaacngcctagagngctaggacggaacgacggctgttgttaattcgttggttgacgtaaagtntttaacgtagtaggaggtcgaacgggttaaccggggg

SEQ ID NO: 314611 - DNA, 618 bp, Homo sapiens
  misc_feature: GZ8MTXP01CJKDV.11.21.B10.1.454.CMB.2.raw
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (407)..(407): a, c, t, g, unknown or other
  misc_feature (407)..(407): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcaacgtggaggagtcgtgggggagcgtggtccagccgtgggacgtccngagactctcctgtacngcctctggtccttcaccttcattaccatggcatgcacgtcgggtcccnccagcctccgaggcgagggggctgggagtggngntagttattcatatgatggaaatgtntacttnattcagtctcggtagacggcctatccaccgtcncagacactactcagcacgacgtctgtaactcgtagaccaaagtacgaacgacgtaccgtaggagtacgacgtacgggacggtaaccgaccgggttcgttaggttacgttaaacgtttcgttagggttacggaacggttaaagtttacgttttaaccgtaaggttaacggggttacggggttaacgggttaacccggggtttaaccgggggg

SEQ ID NO: 314612 - DNA, 617 bp, Homo sapiens
  misc_feature: GZ8MTXP01B6OP6.11.21.B10.1.454.CMB.2.raw
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
  modified_base (338)..(338): a, c, t, g, unknown or other
  misc_feature (338)..(338): n is a, c, g, or t
  modified_base (483)..(483): a, c, t, g, unknown or other
  misc_feature (483)..(483): n is a, c, g, or t
tcagcgagagataccacgaccggtgctcgatttagtgtcgtcgcaagagaggaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagcctgggagtcctgagactctcctgtacngcctntgcttcacttnataccatgcatgcacgtgggtccnccagacctcgaggcgaggggctggagtgggtgctagttacttnatatgataggaaatgtactacttctattcagtacctcggaggacgggccgtatccgaccgtctaccgaagtacgaactaacttaccgacggaccaaccgaccgtacgttacgttaactcgttacgaacctaaaagtacgaaaacncgtaccgtagagacggtccgtagggaacggaaccgtacgggttcttaggttgttaaacgttcgttaggttcgaaacggtaaagttactttaacgtaagtagggttagggtaacggttaacgggttaaccggggg

SEQ ID NO: 314613 - DNA, 547 bp, Homo sapiens
  misc_feature: GZ8MTXP01EOYTU.11.21.B10.1.454.CMB.2.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctntcctgcagggccagtcagagtgttaacagctacttagcctggtaacccaaacagaaaccctggaccagacctcccaggcctcctnatctatgatgcatccaacgcgggccactggcccaaccccaggcctaggttccaggtcggccaggtgggtctggggacaagtacttcactcctcaccatcagcagctagagcctaggaggttatttgcttagtttattactgttacagtcgagtcgtatcgactggacttcgaaccgttcggacgaaggacacgtaactaggaaattaaacgagtgtaggcttgcaactatctgtcttactcttccgttcccg

SEQ ID NO: 314614 - DNA, 789 bp, Homo sapiens
  misc_feature: GZ8MTXP01CUXFT.11.21.B10.1.454.CMB.2.raw
  modified_base (204)..(204): a, c, t, g, unknown or other
  misc_feature (204)..(204): n is a, c, g, or t
tcagcgagagataccacgaccggtgctcgatttagtgtcgtcgcaaggaggaggggggaggaactgctcagttaggacccagagggaaccatggaagccccagctcagcttctcttcctcctgctactctggctcccagatagcaccggagaaattgtgttgacacagtctccagccaccctgtctttgtctccgaagggaaangtcaccctctcctgcagggccagtcaagagtgttaaacagctacttagcctaggtaaccaaacagaaacctggacccagacctcccaggcctcctacatctatgatgacactaccaaacgcgggacccacgtcggacccaaccccccgaggtaccccgtaagggtttaccaagggttcggggaccccgtaaggggttcgggggtccgttaggggggaaaccctaaacgggtaacccttttcccaacctttaccctaccaaacccctagttacccgaaacgcccgaacggtacccctaaggaacgtcccgttagggtaaacgggtttaattttttcggactttaaggtttttaacttaccgtgttaccgaagtacgtaacggttaccggttaacttccggtaaacgttcgggtaaccttaccggtaacccgtttaccggggaacccgtaaaacggggacctaaacggtaacgttaaacgggttaaaaaactttaaaccggaacgttagggtacgggttaccttcggaacccttaacccgtaagtttccttcgttaccttaccttaaccgttccccgtttaaccccg

SEQ ID NO: 314615 - DNA, 622 bp, Homo sapiens
  misc_feature: GZ8MTXP01A0CB9.11.21.B10.1.454.CMB.2.raw
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
  modified_base (533)..(533): a, c, t, g, unknown or other
  misc_feature (533)..(533): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggagcgtggtccagccgtggggacgtccctgagactctcctgtacngcctntggcttcacttnataccatgcatgcacgtggtccnccagacctcgaggcgagggggctgggagtgggtgctagtttattcatagngataggaaatgtagtacttntatcgagtacctcggtaggaacggtccgtattcgacccgtctaccgaagaacgtaactaacttcccgaagggccaacgacggtacttaggttactcgtaggaactaaacgtacgaaaccacgcctaggacgacgtacgtggaacggtaacgaaccgggttntaggttagttaacgttacgttaggttcgttaacggtaaagttatttaacgtaggtagggttacgggttaacggttaacgggtaacgggg

SEQ ID NO: 314616 - DNA, 520 bp, Homo sapiens
  misc_feature: GZ8MTXP01B1WK8.11.21.B10.1.454.CMB.2.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (277)..(277): a, c, t, g, unknown or other
  misc_feature (277)..(277): n is a, c, g, or t
  modified_base (419)..(419): a, c, t, g, unknown or other
  misc_feature (419)..(419): n is a, c, g, or t
  modified_base (508)..(508): a, c, t, g, unknown or other
  misc_feature (508)..(508): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacngctacttagcctggtaccaacagaaacctggccagacncccaggctcctcatctatgatgcatccaacagggccactggcacccagccagttcagtgcaggtggtctgggacaagacttcactctcacatcagcagcctagagcctgagtatttgctagtttatactgtcagcagcgtancgactggactcgtaccttcggcctaaggggacaacggaactagggttaaacttaaacgacgtgtggcttgacaactatcttcgtcttcncgttcttccccg

SEQ ID NO: 314617 - DNA, 563 bp, Homo sapiens
  misc_feature: GZ8MTXP01ERXGR.11.21.B10.1.454.CMB.2.raw
  modified_base (195)..(195): a, c, t, g, unknown or other
  misc_feature (195)..(195): n is a, c, g, or t
  modified_base (263)..(263): a, c, t, g, unknown or other
  misc_feature (263)..(263): n is a, c, g, or t
  modified_base (304)..(304): a, c, t, g, unknown or other
  misc_feature (304)..(304): n is a, c, g, or t
  modified_base (493)..(493): a, c, t, g, unknown or other
  misc_feature (493)..(493): n is a, c, g, or t
tcagcgagagataccacgaccggtgctcgatttagtgtcgtcgcaagagaggagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtncaacgtggaggagtcgtgggggagcgtggtccagcctgggagtccctgagactctcctgtacagcctntggcttcaccttcatacctatggcatgctacgtgggtcccnccagacctcgaggcgagggggctgggagtgggtgctagtttattcatatgataggaaatgtagactttcgtatttcgagtacctccggtagaacgggccctattcaccgtctcagacgacattccacggcacagctgtatctagacaaatacgaacacgcctagagagtcgtaggaggaacaacggttntggttagtattacgttgttcgagtaaagtatttaacgtaagtaggaggttcggttaacggttaacggggg

SEQ ID NO: 314618 - DNA, 612 bp, Homo sapiens
  misc_feature: GZ8MTXP01CWMV2.11.21.B10.1.454.CMB.2.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (485)..(485): a, c, t, g, unknown or other
  misc_feature (485)..(485): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaangccaccctctcctgcagggccagtcagagtgttaacngctacttagcctaggtaacccaacagaaacctggaccagacctcccaggcctcctcatctatgatgcatacccaacgacgggcccacgtggaccccaccccagcccgtaaggttccaggtcggaccctaggggttgggtccgtaggggacctaagtaccttcgactcctacaccatcagccagcctaggacgccgtaggacggttattttggacttagtttattacgtgtctaggcaggtacgttancggtactggtacttcgtaccccgttcggacccgaaaggggaccacggtaacgtaaagggttaaacttaaacgacgtaggtcggacttcgactaactatctcgtcttactaacttcccgttaaccccg

SEQ ID NO: 314619 - DNA, 562 bp, Homo sapiens
  misc_feature: GZ8MTXP01ELB6D.11.21.B10.1.454.CMB.2.raw
  modified_base (307)..(307): a, c, t, g, unknown or other
  misc_feature (307)..(307): n is a, c, g, or t
  modified_base (430)..(430): a, c, t, g, unknown or other
  misc_feature (430)..(430): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
tcagcgagagataccacgaccggtgctcgatttagtgtcgtcgcaagagaggagggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactgggaggagtcgtgggggagcgtgtccagccgtgggagtcctgagactctcctgtacagcctctggctcaccttcattacctatggcatgcacgtggtccncagactccgaggcagggggctggagtgggtgctaggttattcatagtgaatagggaactagtgtacttactagtcagtacctccgtagaaacgggccgtaattccgaccgtactccgaagganaaccaattccaggccacgacgtctagtactctgacaaagtcgaaacagtccctgacggaatcagggacgcgaacggnttaggttnttacgttaactggtaacacggtaaagttctttaacgttaagtaaggg

SEQ ID NO: 314620 - DNA, 516 bp, Homo sapiens
  misc_feature: GZ8MTXP01EIS01.11.21.B10.1.454.CMB.2.raw
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
  modified_base (418)..(419): a, c, t, g, unknown or other
  misc_feature (418)..(419): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
tcagcgagagataccacgaccggtgctcgatttagtgtcgtcgcaagaggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtggggggagcgtggtccagcctgggacgtcctgagactctcctgtacagcctntggcttcaccttnattacctatggcatgcacgtgggtcccnccagactccaggcagggggctgggagtgggtgctaggttatttcatatgatgggaaaatcgtgaactttctaattcagactccggtgaaaggggccaattcacgtncaganacatacagnacacnnatnganaananaanancngagantgagacgngngtgttatattagtgtagaagttattataatagtaaggtaggtacggttacgggtcggttcgttg

SEQ ID NO: 314621 - DNA, 647 bp, Homo sapiens
  misc_feature: GZ8MTXP01EMSUB.11.21.B10.1.454.CMB.2.raw
  modified_base (381)..(381): a, c, t, g, unknown or other
  misc_feature (381)..(381): n is a, c, g, or t
  modified_base (569)..(569): a, c, t, g, unknown or other
  misc_feature (569)..(569): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaaaacgtggaggagtcgtgggggaggcgtggtccagccgtgggagtccctgagactctcctgtacacgcctcgtggccttcaccttctactacctatcggcatcgcctacgtcgggtcccgccagacctccgagggccggagggggtctggggaggttggggtggtactagtttattcattagngtagtagtaaatgtacgtacttctattcaacgtaccgtccgggtaggaaccggggtcctacttccgaccgtcgtaccaagtaacgtaacctaacttaccaggtaccaacgaccggtcttaggttactccgtagaacctaaagtcgaaactcgaccgtaggagacgtacgtacggacggaacgtacggnttagttcgtaagttacgttggttacgttaagtaactatttaacgaagtagggttaggtcggttaacggttaacggggg

SEQ ID NO: 314622 - DNA, 620 bp, Homo sapiens
  misc_feature: GZ8MTXP01BP87F.11.21.B10.1.454.CMB.2.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacngctacttagcctggtaccaacagaaacctggccagacncccaggctcctnatctatgatgcatccaacncgggccactggccaccccagccaggttcaggtggccaggtggggtctggggacaagacttcactctacaccatcagcacgcctaaggacgcctaggtaggttacttttggacttaaggttttacttacgtcgttccgaggtcgaacggtcgttactaccggtaacttcgggacttacccggtacccgtttccgggaacccgaacggggtaaccaaccggtaaacgttaagggaaaacttaaaaccggacgtaagggttcggacttcggacctaacccattcctacgttcttacctaacgttcccttccccg

SEQ ID NO: 314623 - DNA, 535 bp, Homo sapiens
  misc_feature: GZ8MTXP01BYRT9.11.21.B10.1.454.CMB.2.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (376)..(376): a, c, t, g, unknown or other
  misc_feature (376)..(376): n is a, c, g, or t
  modified_base (490)..(490): a, c, t, g, unknown or other
  misc_feature (490)..(490): n is a, c, g, or t
tcagcgagagataccacgaccggtgctcgatttagtgtcgtcgcaaggaggaggggggaggaactgctcagttaggacccagagggaaccatggaagccccagctcagcttctcttcctcctgctactctggctccagatagcaccggagaaattgtgttgacacagtctccagccacctgtctttgctcaggggaangccacctntcctgcagggccagtcagagtgttaacngctactagcctggtaccaacagaaacctggaccagactcccaggctctcatctatgatgcatccaagagggccaacgtcggacacccccgagccaggttcaggtgaccaggtggggctgggactaagacttcactctcaccntcagcagtccagagctgaggtatttgactagtttattactgtacagtcagcgtaatcggattggctcgacttcgacccgaggaccacgaactaggaaattaaccgagttaaggnggacttcggacaacccatctcggtcttctaacgttccgttccccg

SEQ ID NO: 314624 - DNA, 550 bp, Homo sapiens
  misc_feature: GZ8MTXP01CSYTG.11.21.B10.1.454.CMB.2.raw
  modified_base (305)..(305): a, c, t, g, unknown or other
  misc_feature (305)..(305): n is a, c, g, or t
  modified_base (412)..(412): a, c, t, g, unknown or other
  misc_feature (412)..(412): n is a, c, g, or t
  modified_base (435)..(435): a, c, t, g, unknown or other
  misc_feature (435)..(435): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaaactgggaggagtcgtggggggaggcgtggtccagcctggggaggtccctgagactctcctgtacagcctctggcttcacttcatacctatggcatgcactgggtccnccagactccaggcaggggggctgggagtggggtgcagtattcatatgatgaaatagtagacttctattcagactccgtcgaagggccggattcaccgtctccagaanaacaactacacgacacacgactntagtactacgacaaataacgaacgacgacgtacgagagacgagaggaacgacgcgtgttagttattaacttagttgacgtaaagtaagttaattatagttaggtaagaacggtaa

SEQ ID NO: 314625 - DNA, 557 bp, Homo sapiens
  misc_feature: GZ8MTXP02IY1CC.11.21.B10.1.454.CMB.2.raw
  modified_base (201)..(201): a, c, t, g, unknown or other
  misc_feature (201)..(201): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctctcctgcagggccagtcagagtgttaacagctacttagcctggtaccaacagaaacctggccagactcccaggctcctcatctatgatgcatcccaaacaggggcccacgtcggacccaccccgagccccaggtttccaggtcggccaggtgggtctggggacagacttcactctcaccatccagcagcctagacgctgagtattttgactagtttatacgtgtcagcagtcgtatcgactggacttcaccgttcggaccgaaacggggacacggtacgtacggtaaaattaaaccgaagtacgtcggactagacaaccgtatctacgtcctttacacttccttcccg

SEQ ID NO: 314626 - DNA, 551 bp, Homo sapiens
  misc_feature: GZ8MTXP02HUDXL.11.21.B10.1.454.CMB.2.raw
  modified_base (200)..(200): a, c, t, g, unknown or other
  misc_feature (200)..(200): n is a, c, g, or t
  modified_base (380)..(380): a, c, t, g, unknown or other
  misc_feature (380)..(380): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaanagccacctctcctgcagggccagtcagagtgttaacagctacttagcctggtaccaacagaacctggccagactcccaggctcctcatctatgatgcatccaacaggccactggccacccagccaggttcagtgccagtggtctgggacagacttcactctcaccatcagcagcctaganctgagtatttgctagtttatactgtacagtcagcgttatcgaactggatcaccgttcggaccaaaggggaccaacggtactaaggtaaaagtttaaaaccgaaacgttaggtacgggcttacggacaaacccgtattacctcgttacctttaccaactttccctttccccg

SEQ ID NO: 314627 - DNA, 505 bp, Homo sapiens
  misc_feature: GZ8MTXP02FKKY9.11.21.B10.1.454.CMB.2.raw
  modified_base (201)..(201): a, c, t, g, unknown or other
  misc_feature (201)..(201): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctctcctgcagggccagtcagagtgttaacagctacttagcctggtaccaacagaaacctggccagactcccaggctcctcatctatgatgcatcccaacagggccacgtggccaccccagcccaggttcaggtggccaggtggtctggggacagacttcactctcaccatcagcagcctagacgctgagtatttgctagtttatactgtcagcagcgtatcgatgatcacttcggaccagggacacgactaggaaaattaacgactgtacgctgcaacatctgtctcacttctcccg

SEQ ID NO: 314628 - DNA, 538 bp, Homo sapiens
  misc_feature: GZ8MTXP02I23RH.11.21.B10.1.454.CMB.2.raw
  modified_base (200)..(200): a, c, t, g, unknown or other
  misc_feature (200)..(200): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaanagccaccctctcctgcagggccagtcagagtgttaacagctacttagcctggtaccaacagaaacctggccagactcccaggctcctcatctatgatgcatccaacacgggccacgtcggacccaccccagcccaggttccaggtcggccaggtgggtctggggacaggcttcactctcaccatcagcagcctagagctgagtatttgctagtttatactgtacagcagtcgtatcgactggatcgtaccgttcggaccaagggacacgacgtaggaaaacttaaacgaactggtcgactcgaccaaccgtatcttacgtctttacacttccttcccg

SEQ ID NO: 314629 - DNA, 539 bp, Homo sapiens
  misc_feature: GZ8MTXP02HOFV1.11.21.B10.1.454.CMB.2.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctctcctgcagggccagtcagagtgttaacngctacttagcctggtaccaacagaaacctggccagactcccaggctcctcatctatgatgcatcccaaacgacggggcccaacgtcggaccacccccagcccaaggttcaggtggcccaggtgggtctggggacaggtacttcactctcaccatcagcagcctagacgcctgaggtattttgactagtttattactgtacagcagtcgtatcgactggactcacttcggaccaagggacacgactaggaaattaaacgaacgtgtcggactgacaaccatctcgtctctacttccttcccg

SEQ ID NO: 314630 - DNA, 529 bp, Homo sapiens
  misc_feature: GZ8MTXP02FPHHR.11.21.B10.1.454.CMB.2.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctctcctgcagggccagtcagagtgttaacagctacttagcctggtaaccaanagaaacctggccagactcccaggctcctcatctatgatgcatccaaanaggccactggccaccccagccaggtcagtggcagtggtctggggacagacttcactctcaccntcagcagcctaagngctgagtattttgctaagtttatactgtacagcagacgtatacgactgatacacttcggaccgaaagggaacgaacaacgtaggaaaagttaaaacgtaaacgtagtacggacgtcgacaacactctctctactactactccg

SEQ ID NO: 314631 - DNA, 536 bp, Homo sapiens
  misc_feature: GZ8MTXP02IY0ZN.11.21.B10.1.454.CMB.2.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacngctacttagcctggtaccaacagaaacctggccagactcccaggctcctcatctatgatgcatcccaaacagggccacgtggaccaccccagcccaaggttcaggtcggccaggtggtctggggacagacttcactctcaccatcagcagcctagagcctagagtatttgctagtttattactgtacagcagtcgtatcgatggactcaccgttcggaccgtaagggacacgtacgtaggaaaattaaacgaactggtcgactcgacaacctatctacgtctactacttccttcccg

SEQ ID NO: 314632 - DNA, 575 bp, Homo sapiens
  misc_feature: GZ8MTXP02GMO61.11.21.B10.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (386)..(386): a, c, t, g, unknown or other
  misc_feature (386)..(386): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaangcccaccctctcctgcagggccagtcagagtgttaacagctacttagcctggtaaccaacagaaacctggccagacctcccaggctccncatctatgatgcatccaacgagggccacgtggccaccccagccaggttccaggtggccagtgggtctgggacagtacttcactctcaccatcancagcctagcgctgagtatttgctagtttattactgtacagcagtctatcgacgtgactccgtaccgttcgggacctaaaggggaccacggtaacgtaacgggtaaaatttaaaaccggaacgtttgacgggtaccttcggacctaaccgtattcccgtgttacccttcgtaacttcccgtttacccccg

SEQ ID NO: 314633 - DNA, 598 bp, Homo sapiens
  misc_feature: GZ8MTXP02H2ZKZ.11.21.B10.1.454.CMB.2.raw
  modified_base (302)..(302): a, c, t, g, unknown or other
  misc_feature (302)..(302): n is a, c, g, or t
tcagcgagagataccacgaccggtgctcgatttagtgtcgtcgcaagagaggaggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggagcgtggtccagcctgggagtccctgagactctcctgtacagcctctggcttcaccttcattacctatggcatgccacgtcgggtccnccagacctccgaggcgaggggctgggagtggggtgctaagttattcatatgataggaaattgtgtactttctattcaacgtacctccgtaggaaacgggtccgtattccgaccgttcctaccaagacgaactaacttccgaaggaccacgacgtctaggttactcgttagaacctaaatacgaaactacgaccgtagaacgacgcgtaggaacggacgacggtctagtacgtaatttaccgtgtagacgtaaaagttacttacgtacgtaggtacggtacgtaaccggtacggggg

SEQ ID NO: 314634 - DNA, 502 bp, Homo sapiens
  misc_feature: GZ8MTXP02I6FQZ.11.21.B10.1.454.CMB.2.raw
  modified_base (201)..(201): a, c, t, g, unknown or other
  misc_feature (201)..(201): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctctcctgcagggccagtcagagtgttaacagctacttagcctggtaccaacagaaacctggccagactcccaggctcctcatctatgatgcatccaacagggccatggccaccccagccaggttcagtggccagtggtctgggacagacttnactctcaccntcagcagcctagagcctgagatttgctagtttatactgtcagtcagcgtatcgactggatcacttcggccaagggacacgactaggaaattaaacgaactgtcggctgcaacatctagtcttcactcttccg

SEQ ID NO: 314635 - DNA, 510 bp, Homo sapiens
  misc_feature: GZ8MTXP02GWP2C.11.21.B10.1.454.CMB.2.raw
  modified_base (286)..(286): a, c, t, g, unknown or other
  misc_feature (286)..(286): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtcttgtctccaggggaaagagccaccctctcctgcagggccagtcagagtgttaacagctacttagcctggtaccaacagaaacctgccagactcccaggctccncatctatgatgcatccaacagggccactggccaccccagccaggtcagtggccagtgggtctggggacagacttcactctcaccatcagcagcctagagcctgaggatttgctagtttattactgtcagcagcgtatcgactggatcaccttcggccaaggggacacggactgggaaaattaaacgaactgtggctgacaacactctcgctttcactcttcccg

SEQ ID NO: 314636 - DNA, 551 bp, Homo sapiens
  misc_feature: GZ8MTXP02FJ5OT.11.21.B10.1.454.CMB.2.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (426)..(426): a, c, t, g, unknown or other
  misc_feature (426)..(426): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaanagccaccctctcctgcagggccagtcagagtgttaacngctacttagcctggtaccaanagaaacctggccagactccaggctcctnatctatgatgcatccaacagggccactcggcccaccccagcccaggttcaggtggccaggtgggctggggacagacttcactctcacatcagcagcctagcgctgaggtatttgctagtttatactgtacagcagngtatcgactggactctaccgttcggaccgtaagggacaacggtactagggtaaaacttaaaccggacttaggtcgtactcgacctaaccattaccttcgttaccttacacttcccgtttaccccg

SEQ ID NO: 314637 - DNA, 566 bp, Homo sapiens
  misc_feature: GZ8MTXP02H74JW.11.21.B10.1.454.CMB.2.raw
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaagagccaccctctcctgcagggccagtcagagtgttaacagctacttagcctggtaaccaacagaaacctggccagactcccaggctcctcatctatgatgcatcccaacgacgggccacgtcggccaccccgagcccaggttcaggtggccagtgggtctgggacagtacttcactctccaccatcagcacgtcctagacgccgtgaggttatttgacttagtttatactgtacagcgagtcgttatccgatgggacttccgtaccgttcggaccgaaagggtaccacggtaacgtaagggaaaacttaaacggaacttcggtacggctgcaaccgtattctcgttactacctacgttccttcccg

SEQ ID NO: 314638 - DNA, 639 bp, Homo sapiens
  misc_feature: GZ8MTXP02H1I0Q.11.21.B10.1.454.CMB.2.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgctccaggggaangccaccctctcctgcagggccagtcagagtgtaacngctacttagcctggtaccaanagaacctggccagacctccaggctccnatctatgatgcatccaaacgngggcccactcggcccaccccgagcccaggttccaggtcggccagggttcggggtctaggggacaggtaccttcgacctctccaccatcaagtccacgcctagacgtccgtagacggttattttgcttaagtttacttacgtgtactagtactaggtacgtacgtacggtacgtaggtactaccgtacccgttccggacccggaaaggggtaccaacggtaaccgttaacgggtaaaaacttaaaaccggaacgttacgggtacggtaccgttacggaacctaacccgtacttacgttacggttacctttaccgtaccgtttaccctttcccccg

SEQ ID NO: 314639 - DNA, 609 bp, Homo sapiens
  misc_feature: GZ8MTXP02IYKQ0.11.21.B10.1.454.CMB.2.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagcccaccctgtctttgtctccaggggaaanagccaccctctcctgcagggccagtcagagtgttaacngctacttagcctggtaccaacagaaacctggccagactcccaggctcctcatctatgatgcatcccaacgacgggccacgtcggacccacccccgagccctaggttccaaggtcggccctagggtcggggtcgtaggggacaggtacctttcgacttctaccaccatcagcacgcctagacgcctaggaggtattttcgacttagtttatacgtgtacagtcagtcgtatcgactaggtactctaccgttcggacctagtacgggaactaacggtacgtaaacggtaaaacttaaaacggacgttacgttacgggacttacggaacccgtaacctacttaccgtcggttaccttacgtaactttccccg

SEQ ID NO: 314640 - DNA, 587 bp, Homo sapiens
  misc_feature: GZ8MTXP02JFLGR.11.21.B10.1.454.CMB.2.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (313)..(313): a, c, t, g, unknown or other
  misc_feature (313)..(313): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccgaggggaaanacgccaccctctcctgcagggccagtcagagtgtaacagctacttagcctggtaccaanagaaacctggaccagacctccccaggcctcctcatctatgatgcatccaaancgggccactcggacccaccccagccaggttccaggtgccaggtgggtctggggacagtacttcactctacaccatcagcagcctagacgctagagttatttgactagtttatactgtacagcaggtctagcgtactgtactcgtaccgttcggaccgtaaagggaccaacggtacgtaaggaaaactttaaaacgaacgttaggtacggtaccttacgacctaacccgtaattccgtacgttacctttaccgtaacctttcccgtttacccccg

SEQ ID NO: 314641 - DNA, 527 bp, Homo sapiens
  misc_feature: GZ8MTXP02F3KHN.11.21.B10.1.454.CMB.2.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (259)..(259): a, c, t, g, unknown or other
  misc_feature (259)..(259): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaangccaccctctcctgcagggccagtcagagtgttaacngctacttagcctggtaccaanagaaacctggccagactcccaggctcctcatctatgatgcatccaacaggccacgtggccaccccagcccaggttcaggtggccaggtggtctggggacagacttcactctacaccatcagcagcctagacgctgagtatttgctagtttatactgtcagcagcgtatcgactggactctaccgttcggaccaagggacacgtacgtaggtaaaattaaacgaactggtacgactgacaaccgatctcgtcttacacttccttacccg

SEQ ID NO: 314642 - DNA, 504 bp, Homo sapiens
  misc_feature: GZ8MTXP02FE3UU.11.21.B10.1.454.CMB.2.raw
  modified_base (260)..(260): a, c, t, g, unknown or other
  misc_feature (260)..(260): n is a, c, g, or t
  modified_base (368)..(368): a, c, t, g, unknown or other
  misc_feature (368)..(368): n is a, c, g, or t
  modified_base (479)..(479): a, c, t, g, unknown or other
  misc_feature (479)..(479): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaanagaaacctggccagactcccaggctcctcatctatgatgcatccaacaggccactggccaccccagcccaggtcagtgaccagtgggctggggacagacttcactctnaccatcagcagcctagagctgaggtatttgctagtttattactgtcagcagcgtatcgactgatcaccttcgcaagggcaacgactaggaaattaaaacgaactgaggtcngacaacatctcgtctcactctcccg

SEQ ID NO: 314643 - DNA, 530 bp, Homo sapiens
  misc_feature: GZ8MTXP02JTM02.11.21.B10.1.454.CMB.2.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgctcagggaangccaccctntcctgcaggccagtcagagtgtaacagctacttagcctggtaccaanagaactggcagactccagctccncatctatgatgcatccaaacagggccacgtggccaccccagcctaggttcaggtggccaggtgggtctggggacaggacttcactctcaccatcagcagcctagacgcctgaggtattttgctagtttattacttgtacagtcagtcgtatcgatggatcaccgttcggaccaagggacacgtacgtaggaaaattaaacgactgtacggactcgacaacgtacttactcgtcttacgacttccgttaccccg

SEQ ID NO: 314644 - DNA, 585 bp, Homo sapiens
  misc_feature: GZ8MTXP02HGCJH.11.21.B10.1.454.CMB.2.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (259)..(259): a, c, t, g, unknown or other
  misc_feature (259)..(259): n is a, c, g, or t
  modified_base (396)..(396): a, c, t, g, unknown or other
  misc_feature (396)..(396): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccacctctcctgcagggccagtcagagtgttaacngctacttagcctggtaccaanagaacctggccagacctccaggctcctcatctatgatgcactccaaacgaggccacgtggacccaccccgagccaggttccaggtggcctaggtcggtctgggacagacttcgactctcaccatcagcagctagacnctagtagtatttgcttagtttatacttgtacagtcagtcgtatcgactggactcgtaccgttcggaccgtaacgggtacaacggtaacgtaacggtaaaactttaaaaccggaaacgttacgggtacgtaccgttagacctaaccgtacttccgttacgttctttaccgtaaccttccctttacccccg

SEQ ID NO: 314645 - DNA, 574 bp, Homo sapiens
  misc_feature: GZ8MTXP02IEDWE.11.21.B10.1.454.CMB.2.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtcttttgtctccaggggaaanagccaccctctcctgcagggccagtcagagtgttaacngcgttaacttagcctggtaaccaacagaaacctggaccagactcccaggctcctcatctatgatgcatccaacgaggccacgtggccaccccagccaggttcagtgccagtgggctggggacagacttcacttcncaccatcancancaganctgagtattttgcttaagtttactactgtacagtcaggtacgtatcgaattggaactctaccgttcggaccaaaggggacaaaccggtactaaagggtaaaactttaaaacgaaacgttggtacgtcgttacgacctaaccgtagttacctagttcctttacctactttcccgttacccccg

SEQ ID NO: 314646 - DNA, 541 bp, Homo sapiens
  misc_feature: GZ8MTXP02HXWQN.11.21.B10.1.454.CMB.2.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (308)..(308): a, c, t, g, unknown or other
  misc_feature (308)..(308): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctccngcagggccagtcagagtgtaacagctacttagcctggtaccaacagaaacctggccagactccaggctcctcatctatgatgcatcccaaanagggccaacgtggccacccagccaggttcagtggcagtgggtctgggacagcttcactctcaccatcagcagctagagctgagattgtntattattatntnaganagcgtatacgacgtgatactacgtcgacgaacggacgaacgaacgtaagtaaaagtaaaacgtaaacgtacgtacggtacgtacgacaaccgtaactacgtacgttactttacctacttaccttcccg

SEQ ID NO: 314647 - DNA, 576 bp, Homo sapiens
  misc_feature: GZ8MTXP02F9GJS.11.21.B10.1.454.CMB.2.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtcttgtctccaggggaaangccaccctctcctgcagggccagtcagagtgttaacagctacttagcctggtaacccaanagaaacctggccagacctccaggcctcctcatctatgatgacactaccaaacgacgggcccacgtcggacccacccccgagcctaggttcaggtggccgaggtgggtctggggacagtaccttcactctacgacctatcagcacgcctagacgccgtaggtacgttatttgacttaagtttattactgtacagcagtcgtatcgactgactactaccgttcggaccgtaaagggacaacgtaacgtaagtaaaacttaaacggaaacgtggtacgcgtacgactaaccgatcttcgtcttacacttcccttcccg

SEQ ID NO: 314648 - DNA, 758 bp, Homo sapiens
  misc_feature: GZ8MTXP02G69Q7.11.21.B10.1.454.CMB.2.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccacctgtctttgtctccaggggaanagccacctctcctgcagggccagtcagagtgttaacngctacttagcctggaccaanagaaacctggccagacctcccaggcctcctcatctatgatgcatccaaacgacgggcccaacgtcggcccaacccccgagacccgaggggtttccaagggttcggaccctagggttcggggttcgtaggggacacggtacctttccgaacttcctaccaaccctattccgaacggacccaacgtacccgttaaaggaaccgtcccgttagggaacgggtttactttttacgggacctttaaaggtttttaacttaaccgttggttaccgaaacggtcctaaagggttccgttaaacgttccgggaaacgttacggggtaaccttacccgtaaaccccggtttaccggggaaccccgtaaaaggggggtaaccccaaaacgggttaacgttaaacgggggtaaaaaactttaaaaccggaaacggttcggttacgggaccttacggacccgtaacctacgttaccttacggttcctttacctacgtttaccccgttacccccg

SEQ ID NO: 314649 - DNA, 532 bp, Homo sapiens
  misc_feature: GZ8MTXP02IMTOH.11.21.B10.1.454.CMB.2.raw
  modified_base (200)..(200): a, c, t, g, unknown or other
  misc_feature (200)..(200): n is a, c, g, or t
  modified_base (263)..(263): a, c, t, g, unknown or other
  misc_feature (263)..(263): n is a, c, g, or t
  modified_base (307)..(307): a, c, t, g, unknown or other
  misc_feature (307)..(307): n is a, c, g, or t
  modified_base (340)..(340): a, c, t, g, unknown or other
  misc_feature (340)..(340): n is a, c, g, or t
  modified_base (444)..(444): a, c, t, g, unknown or other
  misc_feature (444)..(444): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagcttgggtttttcctcgttgcttctttttaaagaggtgtccagtgtcagggtncaactggaggagtcgtgggggagcgtggtccagcctggggagtccctgagactctcctgtacngcctctggcttcaccttcattaccatggcatgcacgtggtcccncagacctccaggcgagggggctgggagtggggngctagtttattcattatagataggaaatgtgacttctattcagactccgtgaaacgggcattcaccgtctaccagagacaacttcagcacacgctgtatctganaaatagaacagctagagagcagacgacacgctgtagtacttacgtgtagacgaaaagtattactatagtacggtagtacgtacggggg

SEQ ID NO: 314650 - DNA, 677 bp, Homo sapiens
  misc_feature: GZ8MTXP02JFVWU.11.21.B10.1.454.CMB.2.raw
  modified_base (203)..(203): a, c, t, g, unknown or other
  misc_feature (203)..(203): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaancgccaccctctcctgcagggccagtcagagtgttaacagctacttagcctaggtaccaacagaaacctggaccagacctcccaggcctcctcatctatgatgacactaccaacgacgggccacgtcggacccaacccccgagcccgtaagggtttccaaggttcggacccgtaggggttcggggtactagggggaccacggttacctttccgaaccttcctaccaacctatccaggccacgtaccctaggacgtccgtaggtaagggttactttttcgggactttaaggttttacttacgttgttacgaggtactacggtacgttactccggacttacggactaccgtacccgttcggaccgaaagggacacggtaacgtaaacggtaaaacttaaaccggacgttcggtacggtaccttacgaccgtaaccgtacgttcgttacgttccttacttaccttcccgtttaccccg

SEQ ID NO: 314651 - DNA, 669 bp, Homo sapiens
  misc_feature: GZ8MTXP02F9KLZ.11.21.B10.1.454.CMB.2.raw
  modified_base (203)..(203): a, c, t, g, unknown or other
  misc_feature (203)..(203): n is a, c, g, or t
  modified_base (414)..(414): a, c, t, g, unknown or other
  misc_feature (414)..(414): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaangccaccctctcctgcagggccagtcagagttgttaacagtctacttagccttaggtaaccaacaacgaaacctggaccacgacctccgacggcctcctcactctatgatgacactaccgaaaacggccacgtcggaccccaccccgagaccgtaggttcaggtcggcgaggtcgggtcgtagggacagtaccttacacctcctacaacctntaccagccgacgtaccgtacgacgtccgtaggtagttagttttgacgtttagtttattactagttacgagtactaacggtcgttagcgtagttggaccttaccgaacgttccggaaccgtaaacgggaccgtaaacggtaaacgttaaacggtaaaaaccgtttaaaccggtaacgttaggttacggaccttaccggaacctaaaccgtaacttcggttacttaccgttacttaccttcccttaccccgtaaccg

SEQ ID NO: 314652 - DNA, 671 bp, Homo sapiens
  misc_feature: GZ8MTXP02HUHCO.11.21.B10.1.454.CMB.2.raw
  modified_base (302)..(302): a, c, t, g, unknown or other
  misc_feature (302)..(302): n is a, c, g, or t
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
tcagcgagagataccacgaccggtgctcgatttagtgtcgtcgcaagagaggagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtggggagcgtggtccagccgtgggagtccctgagactctcctgtacagcctctggcttcaccttcattacctatggcatgcacgtgggtccncagacctccaggcgaggggctggagtgggngctagttattcatntgatggaaaatgtcgtacttctagttcaaggtacccttccgggtagaaacggggtccctatttaccgacccggttctacccgaagtaacgtaaacctaaactttcccgaacgggaccctaaaccgaccgtacgtttaacggtaacttcccgttaaggaacctaaaagttacggaaaacacggtacccttaggaagtacgacgtacgaacgggtaacccgagggttactcggttacgtttaagttaccgttgtaccggtaaacgaaaagtttattttacgttaaacgaagggttacggtacggttaaaccgggtttaacccggggg

SEQ ID NO: 314653 - DNA, 679 bp, Homo sapiens
  misc_feature: GZ8MTXP02IRUN7.11.21.B10.1.454.CMB.2.raw
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgttctttgtctccgaggggaaagcgcccaccctctcctgcagggccagtcagagtgttaacagcttacttagcctaggtaaccaacgaacgaaacctcggaccagacctcccgaggtcctcctcatctatgatgactactcccaacgacggccacgtcggaccccaccccgagcccgtaaggttccgaagggttcggacccgtacggggttcggggtcgtacggggaactaccggtactttccgaccttcctaccaccctatcagcccacgtcccgtagacgcctaggtagttacttttcgacttagttttacttacgtcgtacgacgtacgtacgtcgttacgtcggtacgttggtaccttaccggtacccgttcgggacccgaaaagggcaaaccggttaacgtaaacggttaaaacttaaacgtaacgttggtaccggtacgtacgacctaacctacgttccgtacttcctttaaccgtcttccccgtttacccg

SEQ ID NO: 314654 - DNA, 685 bp, Homo sapiens
  misc_feature: GZ8MTXP02I6GYG.11.21.B10.1.454.CMB.2.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
tcagcgagagataccacgaccggtgctcgatttagtgtcgtcgcaagggagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaancgccaccctctcctgcagggccagtcagagtgttaacagtctacttagcctggtaaccaacagaaacctggtcagacctcccgagctcctnatctatgatgcaactccaaacgacgggcccacgtcggacccaccccgagccctaagggtttccaaggttcgggacccgtaggggttcggggtacccgtagggggaaccaacggtacctttccgaccttaccctacccaaaccctactaccgaaggtcccaacgtccctaaaggccgtacccgttagggtaaagggttatttttcggactttagttttaactacgttgtacgagtacgacggtcgtaagtccggaacgtaggtaccttaccgtacccggttacgggaccgtaaaggggaccacggtaaacgtaagggtaaaaacttaaacggacgttggtacgtactcgaacctaaccgtattacttcgtacttactactttccctacccg

SEQ ID NO: 314655 - DNA, 561 bp, Homo sapiens
  misc_feature: GZ8MTXP02JZYWI.11.21.B10.1.454.CMB.2.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
  modified_base (425)..(425): a, c, t, g, unknown or other
  misc_feature (425)..(425): n is a, c, g, or t
tcagcgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagcccaccctgtctttgtctccgaggggaaanagccaccctctcctgccagggcccagtcagagtgtaacagctacttagcctggtacccaanagaacctggccagactcccaggctcctcatctatgatgcatccaagacggccacgtggcccacccagccagttcagtcgcagtggctgggacagcttcactctcaccatcagcagctagcgctgagtatttgactagtttatactgtcagtcacgcgttancggactggacttcgacccgttcgggaccaaggaccgtaacggtacttaaagggaaaacttaaaccggaaaccgttggtacggacttcggacctaacctacgttaccgtcgttcccttacctacttcccgtttcccg

SEQ ID NO: 314656 - DNA, 725 bp, Homo sapiens
  misc_feature: GZ8MTXP02GAX3L.11.21.B10.1.454.CMB.2.raw
  modified_base (202)..(202): a, c, t, g, unknown or other
  misc_feature (202)..(202): n is a, c, g, or t
  modified_base (669)..(669): a, c, t, g, unknown or other
  misc_feature (669)..(669): n is a, c, g, or t
  modified_base (676)..(676): a, c, t, g, unknown or other
  misc_feature (676)..(676): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccacctgtctttgtctccgaggggaaancgccaccctctcctgcagggccagtcagagtagttaacagcttacttacgcctaggtaaccaagaacgaaaccgtggacccagtacctcccgaggtcctcctcatctagtagatcgactactaccgaacgacgggtccacggtcggaccccaccccgacggcccgtaaggttcagggttcggacccgtaggggttcgggtcgtacggggaactaccggttacccttcaccttacgtacccaacccgtataccgaacggcctaacgacccgttaaaggaccggtccgtagggttaacggtttaacttttcgggaacttttaacgtttttaactaccgtgtaaccgtacgtacgtaacggtacgttacgttacccggagttaccggtaacttaccccgtaccggttaccggaccgtaaacgggacctaacggtaacgtaaaaggttaaaacttaaccggaagtttcggngtaccgngtaaccaacgtcgttacgttacgtccttaccgtaccttcccttaacccg

SEQ ID NO: 314657 - DNA, 665 bp, Homo sapiens
  misc_feature: GZ8MTXP02IIDEH.11.21.B10.1.454.CMB.2.raw
  modified_base (199)..(199): a, c, t, g, unknown or other
  misc_feature (199)..(199): n is a, c, g, or t
  modified_base (373)..(373): a, c, t, g, unknown or other
  misc_feature (373)..(373): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccacctgtctttgctcgaggggaangccacctctctgcagggccagtcagtagtagttaacagtcttacgttagcctaggtaaccaagaacgaaacctggccaagcctcccgaggacctcctcatctatgatgctaactacccgaaacgcgggacccaacgtccggaccccaaccccgtagcccgttaagggtttaccngggttacggaccgtacggggttcggggtctaggggacctaaggttacccttcaccttccaacccgtaacccagttccgaaagcccgtaaacgtcgtaaagtacggccgttaagggtagttagttttcgaacgtttagtttaactacgtgtacgagtcgagtcgttatcgatcgatacgtcgtacggacccgaagggacccttaacgacgttaagaaaacgttaccgtaaacgtggttaccggactacgaccgtaaactcgtccttacgttcctacttcccgttccgtacccg

SEQ ID NO: 314658 - DNA, 695 bp, Homo sapiens
  misc_feature: GZ8MTXP02H6GLX.11.21.B10.1.454.CMB.2.raw
  modified_base (533)..(533): a, c, t, g, unknown or other
  misc_feature (533)..(533): n is a, c, g, or t
  modified_base (681)..(681): a, c, t, g, unknown or other
  misc_feature (681)..(681): n is a, c, g, or t
tcagcgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgttcttttgtctccgaaggggaaagtacgtccaccctctcctgcgacgggccaggtcagagttagttaacagcttacttaggccttaggtaaccaacaagaaaccctggaccagacctacccaggcctcctcactctaatgatcgcaatcccgaaacgccggggaccacgtcggacccaccccgagtacccgacgttcgaggtcggccgtagggttgggtcgtaggggactaacggtcctttccacttcctaccacctaacgtcgaaacgtcaacgtactaacggtacgtccgttaaggtaggtttactttttacggactttaaggtttttaaactcgttcgtacgtaccgngttaacgggtaccgttagaccggtttacgcggttactaccggtacccgtttaccgggaccgttaaacgggacgtaccgtaaagttaacggtaaaactaacggttaaacgtgttaccggctacgactaactctttacgtacttcttacncggtttccctcccg

SEQ ID NO: 314659 - DNA, 589 bp, Homo sapiens
  misc_feature: GZ8MTXP01E080E.52.33.C11.1.454.CMB.2.raw
  modified_base (189)..(189): a, c, t, g, unknown or other
  misc_feature (189)..(189): n is a, c, g, or t
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
tcagcgcagtacgacacgaccggtgctcgatttagagtgagctcgttgggtttgggggtgggtccaggaggcagaactctgggtgtctcaccatggcctggatccctctacttctcccctcctcactctctgcacaggctctgaggcctcctatgagctgacacagcccaccctggtgtctgtgtcctnaggacagacggccaggatcacctgctctgganatgcattgaccaaagcaaatntgtcttactggtaccagcagaacgcccggcacggcccctgtcttgctttatttaataaagtactttgagacggccctcgacggtacccctgacgcgtattctccgtggctccgagcctacgacgccgaacaaacgacgtactacgttcgacctagtcgaggtggacgtccgaagggacaaggagggacgagggctagtaacttattacgtggtcagtcatcagacagcgagtggactacgttagtcgttcgttaggttccgggacgggtaacgggaacccttaaacgttcggttacccggttaaccgtagggtccgacggacccggacgtcccgttcccgtcccccg

SEQ ID NO: 314660 - DNA, 637 bp, Homo sapiens
  misc_feature: GZ8MTXP01A5CN3.52.33.C11.1.454.CMB.2.raw
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagcgtggtttcgcgtagctctttaagaggcgtccagtgtcaggtgcagctggtggagtcgtggggggggctggtccaggctggggaggtccctgagactctcctgtgcagcctntggattcacctcagtacccatagaatgctacgtgggtccncgaggctccgaggcgaagggggctagggagtgggtgactacttatactccctagtagagtaggaacaacaaagtaacgacgacgtacgacgacgtacggtacgtacgacggacgtacgtacgactactacgtaccgacgaacgaacgaacgtacgtaaacgtaacgttaacgttacgttaactaaacgtaaacgtaacgtaacgacgtacgtacgacgacgtacgtacggtacggaacggtaacggtacgttacgttacgtttacgttacggtacggacggacggttacgggtaacgtacgtaacgtacgtacgacgtaaccgttaaccgtaacg

SEQ ID NO: 314661 - DNA, 570 bp, Homo sapiens
  misc_feature: GZ8MTXP01AMPNC.52.33.C11.1.454.CMB.2.raw
  modified_base (267)..(267): a, c, t, g, unknown or other
  misc_feature (267)..(267): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
  modified_base (474)..(474): a, c, t, g, unknown or other
  misc_feature (474)..(474): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcggtggggggggctggtccagggctggggaggtccctgagactctcctgtgcagcctntggattcacctcagtacccatgaaatgcactgggtccgccaggcctccgagggacgaagggggctgggaggtgggggtggctacttagtactccctaatgagtggaagacaaataacgcaactacgcagacgtccggtagaagggccgattcgaccatcctacgaganacaacagaaanacgttacgtctactaacaaatacgaacngctaggagacgcgtaggacggcaacggtcttattaccgtttagtgtggttacggagttaagggaacctagaacttacacgactaacgcccgtaaag

SEQ ID NO: 314662 - DNA, 668 bp, Homo sapiens
  misc_feature: GZ8MTXP01CD0R0.52.33.C11.1.454.CMB.2.raw
  modified_base (304)..(304): a, c, t, g, unknown or other
  misc_feature (304)..(304): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagcttgggttttcctcgttgctcttttaagaggcgtccagtgtcaggtgcagctggtggagtcgtggggggggctggtccaggctggggacgtccctgagactctcctgtgcagcctctggattcactcagtacccatgaaatgcactgggtcccncaggctccgaggcgaagggggctgggagtggggtgctacgttatactcccctatgagtaggaagacaaataagcaactacgcagacgtccgtggaaacgggcctaagttcgacctatctaccgaggacgacaaacgtcgaaaagtaacttaccgggtttacttacgtaaacctaaagtacggaaaccacggttaccctagggaacgtacgaccgttagggaacgggaaacccgtaaccggggttaccctttaaatttccccgttttttaaacgggtcgggttacggaaccgggttaacgggttaaaccgggtaaccttacgtaacgttaaccggacggttaccgtaaccgttaacccgtaaacg

SEQ ID NO: 314663 - DNA, 532 bp, Homo sapiens
  misc_feature: GZ8MTXP01BI3BT.52.33.C11.1.454.CMB.2.raw
  modified_base (373)..(373): a, c, t, g, unknown or other
  misc_feature (373)..(373): n is a, c, g, or t
tcagcgcagtacgacacgaccggtgctcgatttagagtgagctcgttgggtttgggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcagaacgcccggcacggcccctgtcttgcttatttataaagtactttgagacggccctacgacggacccctgacgcgattctcctggctcagctacagcgacaaacagtcacgtnaccatcagtgagtcaggcaggagacgaggctagactattactggtactagtcatcaagacagcgagtggactacttagtcgtacgttagttcgggacggaacgggaaccaaacgttcgaacccgtcgtagggccacggaccaagggccttccgcccccg

SEQ ID NO: 314664 - DNA, 565 bp, Homo sapiens
  misc_feature: GZ8MTXP01AWQ2C.52.33.C11.1.454.CMB.2.raw
  modified_base (220)..(220): a, c, t, g, unknown or other
  misc_feature (220)..(220): n is a, c, g, or t
  modified_base (361)..(361): a, c, t, g, unknown or other
  misc_feature (361)..(361): n is a, c, g, or t
  modified_base (422)..(422): a, c, t, g, unknown or other
  misc_feature (422)..(422): n is a, c, g, or t
tcagcgcagtacgacacgaccggtgctcgatttagagtgagctcgttgggtttgggggtgggtccaggaggcagaactctgggtgtctcaccatggcctggatccctctacttctcccctcctcactctctgcacaggctctgaggcctcctatgagctgacacagccaccctcggtgtctgtgtcctcaggacagacgccaggatcacctgctctgganatgcattgaccaaagcaatatgcttactggtacagcagaacgcccggcacgcccctgtcttgcttattataaagctttgagacggccctgacgggacccctgacgcgtattctccgtcggctccgagctacagcgacaacngtcacgttgaccatcgagtggacgtccgaggcaaggacggacgaggctagacttattacgnggtcagtcatcagacagctaaggtcgactacttagtcgttacgttaggttccgggacgggaacgggtaacccaaacgttccggacccgttccgttaacggggtccaaccgggacccgaacgggtcccgttcccgtccccccgg

SEQ ID NO: 314665 - DNA, 539 bp, Homo sapiens
  misc_feature: GZ8MTXP01B4JLM.52.33.C11.1.454.CMB.2.raw
tcagcgcagtacgacacgaccggtgctcgatttagagtgagctcgttgggtttggggtggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaaccgatatgcttattgtaccagcagaagccgggccacggcccctgtgttggtgatagtaataaagcactgagacggccccctcgagggactccccgtgaacgcgtaattctcgtgggccttccgaggtcgaagggacctaaggtcactagtgcaatcagtggagtccgaggcaggaggggacgaggctcgattattagtgtacaatacaacagacaactaattgtacttagtcgtcttcgacttgtaacgactaaggtccaccggttctcgggttcaacccg

SEQ ID NO: 314666 - DNA, 553 bp, Homo sapiens
  misc_feature: GZ8MTXP01A0R9O.52.33.C11.1.454.CMB.2.raw
  modified_base (204)..(204): a, c, t, g, unknown or other
  misc_feature (204)..(204): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (501)..(501): a, c, t, g, unknown or other
  misc_feature (501)..(501): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganacgccaccctctcctgcagggccagtcagagtgttggcaactcttagcctagtaccaacaaaactgccagctccagctctnatctatnatgcatcccagacgggccacgtggcatccccagcctaggttcagtgcaggtgggtctgagacaagtaccttcactcncacatcagtcgctcgagtcctgaagttntttagctagtttatactgtacagtccgaggtcgtagccacgtggcttcgtcgtttcggggcggtagggtaccgtaaagggttgaagtaacttacgaaaaccggngttagggtcgacttcggacctaaccatctgttcttctaacttcccgttcccg

SEQ ID NO: 314667 - DNA, 515 bp, Homo sapiens
  misc_feature: GZ8MTXP01BF7J5.52.33.C11.1.454.CMB.2.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (271)..(273): a, c, t, g, unknown or other
  misc_feature (271)..(273): n is a, c, g, or t
  modified_base (276)..(281): a, c, t, g, unknown or other
  misc_feature (276)..(281): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctccagataccaccggagaagttgtattgacacagtctccagccacctgtctttgtctccgaggggganacgcccaccctctcctgcagggccagtcagagtgtgcactntagctgacaanaaactgcagcncngcncnnntannnnnncagngcangcatccancgagtcagtgctagtggctgagacaagacttcactcncaccatcagtcgcctganctagagttntttgcttatttatacngtacagcagggctacgccacgtggccttcgttcggttacggggcggtaacgggaccgtaagggttgaaagtacttacgaaaaccgttagtcggtcggacttcgacctaactattctgtcttctaacttccgtaacccc

SEQ ID NO: 314668 - DNA, 590 bp, Homo sapiens
  misc_feature: GZ8MTXP01BGVNL.52.33.C11.1.454.CMB.2.raw
  modified_base (223)..(223): a, c, t, g, unknown or other
  misc_feature (223)..(223): n is a, c, g, or t
tcagcgcagtacgacacgaccggtgctcgatttagagtgagctcgttgggtttgggggtgggtccaggaggcagaactctgggtgtctcaccatggcctggatccctctacttcctccccctcctcactctctgcacaggctctgaggcctcctatgagctgacacagccaccctcggtgtctgtgtcctcaggacagacggccaggatcacctgctctgganatgcattgaccaaagcaatatgcttactggtacagcagacgcccgcacgcccctgtctgcttatttaataaagtactttgagacggccctacgacggaccctgacgcgtattctccgtcggctccgacgtcctacaacgcgaacaaacgacgtaccacgttacgactatacgagtggacgtccgaggacaaggacggacgaggactagaacttattaccgtgggtacagtacactcgaagacgagacagtcggacttacgttagtgtacgttacgttcgggacggtaaacgggaaccttaaacggttcgacccgttaaccgtaggtaacccgacggaccccgttaaggtcccgttcccggtcccccg

SEQ ID NO: 314669 - DNA, 604 bp, Homo sapiens
  misc_feature: GZ8MTXP01C1RXD.52.33.C11.1.454.CMB.2.raw
  modified_base (313)..(313): a, c, t, g, unknown or other
  misc_feature (313)..(313): n is a, c, g, or t
  modified_base (371)..(371): a, c, t, g, unknown or other
  misc_feature (371)..(371): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctgggtggaggtcggtgggggggggcgtggtccgagggcgtggggaggtccctgagactctcctgtgcagcctctggatcacctcagtacccatagaaatgcacgtcgggtccncgagcctccgaggcgaagggggctagggaggtggggtggctacgttatagtcccctangataggaagacaaataacgcaacgtaacgcaagacgtccgtagggaacggtccgattacgaccattccaccgaagaacgaaccaaacgtacgaaagtaacgttaccggttacttacgtaaactaaatacggaaacctaggcctagaaagcgtacgtagacggacaacggtcttaagttccttagtgtgacggaggagggaactggtaactacaggttacaacgaaccgtaacg

SEQ ID NO: 314670 - DNA, 643 bp, Homo sapiens
  misc_feature: GZ8MTXP01B6SS3.52.33.C11.1.454.CMB.2.raw
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
tcagcgcagtacgacacgaccggtgctcgatttagagtgagctcgttgggtttggggaggaactgctcagttaggacccagagggaaccatggaagccccagctcagcttctcttcctcctgctactctggctcccagataccaccggagaagttgtattgacacagtctccagccacctgtctttgtctccgaggggganagccaccctctcctgcagggccagtcagagtgttggcaacctnttagcctggtaaccaacaaaacctggaccaggctcccaggctctcatctatgatgcatccacgacggccactggcactcccagcctaggttcagtggcaggtgggtctgagacaagtacttcactctcactatcagtcgcctcgacgtccgtagtaagttgttttgacgttaagttttacttacgttgtcagtacacgggtacgttagccctaacgtggtaccttcgttcgttttccggggacgggtaacggggtacccgtaaaggggtttcgaaacggtacgtttaaaccgaaaaccgggttacgtttacggggtaacggttccgtttcggacccttaaccgtacgtttcccgtttcggttacccttttacccgtaaccgttttccccgtttcccccg

SEQ ID NO: 314671 - DNA, 610 bp, Homo sapiens
  misc_feature: GZ8MTXP01DMHJ6.52.33.C11.1.454.CMB.2.raw
  modified_base (205)..(205): a, c, t, g, unknown or other
  misc_feature (205)..(205): n is a, c, g, or t
  modified_base (293)..(293): a, c, t, g, unknown or other
  misc_feature (293)..(293): n is a, c, g, or t
  modified_base (577)..(577): a, c, t, g, unknown or other
  misc_feature (577)..(577): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtcgtccgagggggganacgcccaccctctcctgcgagggccagtcagagtgttggcaacctcttagcctggtaaccaaacaaaactggccaggcctccagctcnatctatgatgcatccgacggacggccacgtgcactcccagccgtagttccaggtggctaggtcgggtctagacgacaagacctttcaacctctacgaaccatcgaggtcgcctgactcgtagaagttatttcgacttaagttttactacgtgtcagtcacggggtcggttaaccgcctacgttcgtccttcgttaccgggttacggggacggtaacgggtaacgttaagggtgaagtaacgttaaacgaaacgttacgtcgggtcgttacgttcgacctaactnttcgttcgttacttaccgtccgtttcccgtccg

SEQ ID NO: 314672 - DNA, 564 bp, Homo sapiens
  misc_feature: GZ8MTXP01A94TU.52.33.C11.1.454.CMB.2.raw
  modified_base (308)..(308): a, c, t, g, unknown or other
  misc_feature (308)..(308): n is a, c, g, or t
  modified_base (473)..(473): a, c, t, g, unknown or other
  misc_feature (473)..(473): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctgggtggaggtcgtggggggggctggtccaggctggggaggtccctgagactctcctgtgcagcctctggattcacctcagtacccatagaaatgcacgtcgggtccnccgaggctccgaggcaagggggctgggaggtggggtgctacttatactccctatgataggaagacaaataagcaactacgcagacgtccgtaggagggcagttcgaccatctaccagacgacaactacgaaagaattacggttacttactaacaaatcggaaacngcctgaacgagtccgtagagcgaacggtcttattctttacgtgtgacggaggacgggtaactcgaacttacgacgctaaccgccgtaacgg

SEQ ID NO: 314673 - DNA, 543 bp, Homo sapiens
  misc_feature: GZ8MTXP01EG91C.52.33.C11.1.454.CMB.2.raw
  modified_base (258)..(258): a, c, t, g, unknown or other
  misc_feature (258)..(258): n is a, c, g, or t
  modified_base (298)..(298): a, c, t, g, unknown or other
  misc_feature (298)..(298): n is a, c, g, or t
  modified_base (449)..(449): a, c, t, g, unknown or other
  misc_feature (449)..(449): n is a, c, g, or t
  modified_base (458)..(458): a, c, t, g, unknown or other
  misc_feature (458)..(458): n is a, c, g, or t
  modified_base (509)..(509): a, c, t, g, unknown or other
  misc_feature (509)..(509): n is a, c, g, or t
  modified_base (526)..(526): a, c, t, g, unknown or other
  misc_feature (526)..(526): n is a, c, g, or t
tcagcgcagtacgacacgaccggtgctcgatttagagtgagctcgttgggtttggggtggggagcctagctgtgctgtgggtccaggaggcagaactctgggtgtctcaccatggcctggatccctctacttctccccctcctcactctctgcacaggctctgaggcctcctatgagctgacacagcccaccctggtgtcagtcgtccccaggacagacgccaggatcacctgctctggagatgcattgaccaaacgntatgcttatgtaccagcagagccgggcaggccctgtgtgngtatgtaataaagcacgtgagacggccccctagagggtactcccgtgaacgcgtaatttcacgttggcctaccgagggtcaaggggacaacggtcaactagttcggccaatccgaaggtcggacgtccgaaggcaggaggggacgaggtcngaactattnttgaacaatcaaacacaacaacttagttagtacttgtcgtacgttacgacncgaacgacgtaacgtcncgttcgtcggcgaaccg

SEQ ID NO: 314674 - DNA, 627 bp, Homo sapiens
  misc_feature: GZ8MTXP01D14W6.52.33.C11.1.454.CMB.2.raw
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
  modified_base (314)..(314): a, c, t, g, unknown or other
  misc_feature (314)..(314): n is a, c, g, or t
  modified_base (359)..(359): a, c, t, g, unknown or other
  misc_feature (359)..(359): n is a, c, g, or t
tcagcgcagtacgacacgaccggtgctcgatttagagtgagctcgttgggtttggggtggggagcctagctgtgctgtgggtccaggaggcagaactctgggtgtctcaccatggcctggatccctctacttcctcccctcctcactctctgcacaggctctgaggcctcctatgagctgacacacgcccacccgtggtgtcagtcgtccccaggacagacggccaggatcactgctcgtgganatgctattcgaccaaacgntatgtacttagtcgtacagacaggaacgccgggccacggccctgtgttgtntatgtaataagacatgagcgcccctcgaggctccctagacgtctntctcgtcggctaccggagggtacgaagggaaccgaacggttcaacgtagttcggactagtcgagtcgggaacgtacccgagggacgaagggaacgggggaacggtcgggtaaccttaggtaactttaagtttacgttaggtaactaaacgtaccaaacgtacgaaccctaaacgttagttacgggtttacttagttacggttcctttaacgggacttacgaaccgtaaccgaacggttccgaccgttacgttcgggaacgaaccccgg

SEQ ID NO: 314675 - DNA, 613 bp, Homo sapiens
  misc_feature: GZ8MTXP01C9P7M.52.33.C11.1.454.CMB.2.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggganacgccaccctctcctgcagggccagtcagagtgttggctaacctcttacgcctggtaaccaaacaaaactggaccaggctacccaggctcncatctatgatgcactccacgtacggccacgtggcactcccgagcctaggttcaggtggctaggtcgggtctgacgactaagtacttcactccgacacatcaggtcgcccttcgacgtcgtagaagttctttaggacttagttttatacgtgtacagctaggggcttagcctacgtcggtccttcgttcggtttcggggacgggtaacgggtacctaagggttcgaagtaacgttacgtaaaaccggttcgttggtcggttacgttcggaccctaacgtatccgtttcgtaccttacgttaaccttcccgtttaaccccg

SEQ ID NO: 314676 - DNA, 745 bp, Homo sapiens
  misc_feature: GZ8MTXP01DFS46.52.33.C11.1.454.CMB.2.raw
  modified_base (275)..(275): a, c, t, g, unknown or other
  misc_feature (275)..(275): n is a, c, g, or t
  modified_base (314)..(314): a, c, t, g, unknown or other
  misc_feature (314)..(314): n is a, c, g, or t
  modified_base (342)..(342): a, c, t, g, unknown or other
  misc_feature (342)..(342): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcgaggtgcagcgtgggtggaggttcggtgggggggggctggtccgagggcgtggggacggtccctgagactctctgtgcagcctntggattcactcacgtacccatagaatcgcacgtcggccncgtacggctaccgaggaccgaagggggnttagggaggtgggggtgactaacgttatactcccctagtagagtaggaaagtaacaaataacgcaaacgtacgacgaaggacgggttcccgaagggaaacggggccctaagtttacggaaccctttacgtaccctaaccgaagggaacgtaaacctaaaaccgtacggaaaaagtaaacgtttaaccgggttttacctttaaccgaaaacttaaaagtcgggaaaactaccggtaccgtaggaaacgtaaggtcccgtaacgggaagggaaacctaacgggtttaaccgttaaatttttaacccgttttaacgacgggttcggaagggttaacccccgggaaaaggggtaaacccctaggtaaccttaaacgacgacccgggaacgttcccccgtaaaaaggg

SEQ ID NO: 314677 - DNA, 705 bp, Homo sapiens
  misc_feature: GZ8MTXP01BMBU7.52.33.C11.1.454.CMB.2.raw
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagcttgggttttcctcgttgctcttttaagaggcgtccagtgtcaggtgcagcgtgggtggaggtcggtggggggggctggtccgaggcgtggggacgtccctgagactctcctgtgcagcctctggattcacctcagtacccatagaaatgacacgtcgggtcccgcacggcctccgaggacgaagggggctagggaggtgggggtcggactaacgtttatacttcccccgtagtaggaagttagggaaacgaacctaaaagtaacggactaaaccgtaccgacgtaaggtacgggtaccggtaggaaacgggcccgtaagttacggacctatcctaacccgaagacgaaccaacgtacgaaagtaaacgttaccggttacttaacttaaacgaaacgttacgaaaccacgccgttaagaacggacgtaccgtaggacggaaccgtaacgggttacttacgtttacgtttaccgtaggttcggaaccgggttaaggaacgggtaacctcgggtaacttaaccgacggttacccgtaaccggttaaccccgtaaagg

SEQ ID NO: 314678 - DNA, 620 bp, Homo sapiens
  misc_feature: GZ8MTXP01BYBDW.52.33.C11.1.454.CMB.2.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctccagataccaccggagaagttgtattgacacagtctccagccaccctgtctttgtctccgagggggganagccacctctcctgcagggccagtcagagtgttggcaacctntagcctgtaccaacaaactgcaggctccagctcncatctatgatgcatccgacgagggccacgtggccactccccgagtccgtaggtttcaaggtggtacgaggttcggggtctaggacgactaacgtacttcaactctaccacctatcgacgtcggcctaggacgtcctaggtaattcttttaggacttaggttttactacgttgtacagtcctaaggggccgtagtaccacgttcggtccttcgttcgtttacgggggcgggtaacggggaaccgtaaagggtttgaaacgtacgttaaccgaaaacggttcgtgggtcggacttcgggaccctaacgtattcgttcgtcctttactcctttcccgttccccg

SEQ ID NO: 314679 - DNA, 638 bp, Homo sapiens
  misc_feature: GZ8MTXP01AE1VK.52.33.C11.1.454.CMB.2.raw
  modified_base (318)..(318): a, c, t, g, unknown or other
  misc_feature (318)..(318): n is a, c, g, or t
  modified_base (503)..(503): a, c, t, g, unknown or other
  misc_feature (503)..(503): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagcttgggttttcctcgttgcttcttttaagaggcgtccagtgtcaggtgcagctgggtggaggtcggtggggggggggctgggtccagggcgtggggacggtccctggagactctcctgtgcagcctctggattcacctcagtacccatgaaatgcacgtcgggtcccnccgaggcctccgaggacgaagggggctgggaggtggggtggctacttatactccctatgagtaggaagaacaataacgcaacgtacgcagacgtcgaggaacgggcctagttcgacctatcctaccgaagacgaacaaacgtacgaaatacgttaccgttacgttaactaacaaatacgaaaccngaccgtaggaagacgtacgtaggaacggtaccgtaaccggtcgtttattcgttttacgtaggtacggacgggttagggaaacgggtaacttacgtaacgttacgacggttaccgaaccgttaacccgtaaaccgg

SEQ ID NO: 314680 - DNA, 696 bp, Homo sapiens
  misc_feature: GZ8MTXP01BGM7L.52.33.C11.1.454.CMB.2.raw
  modified_base (198)..(198): a, c, t, g, unknown or other
  misc_feature (198)..(198): n is a, c, g, or t
  modified_base (611)..(611): a, c, t, g, unknown or other
  misc_feature (611)..(611): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagcttgggttttcctcgttgcttcttttaagaggcgtccagtgtcaggtncagctggtggaggtcggtggggggggctggtccagggcgtggggacgtccctgacgactctcctgtgcacgcctgtggattccacctcacgtacccatagaaatgcacgtcgggtcccacgacggcctccgaagggccgaagggggtctaggggaggtggggtggacctagttactactcccctaagtggaagtagggaacgaacaaataacggaccaaacgtacgacgtaaggcggtaccggtaggaacggggctaagttacgacctacgtaccgtaccgaaggacgaacgaaacgtaccgaaagtaaacgttaccggtttaccttaacgtaaactaaacgtacgaaacgacgaccgtaggaacgacgtacgtaggaacggacgtaacgtctttaacgttccgttttaacgnggttaacgaccgggttaaggttaaccggggtaacttacgggtaacttaaccggacgttacccgtaacccggttcccgtaaaacgg

SEQ ID NO: 314681 - DNA, 675 bp, Homo sapiens
  misc_feature: GZ8MTXP01AMP7D.52.33.C11.1.454.CMB.2.raw
  modified_base (576)..(576): a, c, t, g, unknown or other
  misc_feature (576)..(576): n is a, c, g, or t
  modified_base (590)..(590): a, c, t, g, unknown or other
  misc_feature (590)..(590): n is a, c, g, or t
  modified_base (626)..(626): a, c, t, g, unknown or other
  misc_feature (626)..(626): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagcttgggttttcctcgttgcttcttttaagaggcgtccagtgtcaggtgcagctggtggagtcggtgggggggctggtccgaggctggggagtccctgacgtctctctgtcgcagcctgtggacttcacctcacgtacccatagaatcgcacgtcggtcccgccgaggcctccgaggacgaagggggctgggaggtggggtacggactaacgtttagtacttccccgttagtaggagtagggaactaaccgaaataacggcctaaaccgtaacggccgaacgggtacggttacccgggtaaaggggaaccggggtacccgtaagtttaccggaacccttacgtacccgtacccgaaaggtaaaccggaaacctaacgtaaccgaaagtaactttaccggttacttaacgtaaacaaatacggaaacncgtaccgagaacgngacgtaggaacgacgaacgtcttaagttctttacgngtcggacgaggacggtaactgtaactcgagaccgtaacgttccgaaacg

SEQ ID NO: 314682 - DNA, 796 bp, Homo sapiens
  misc_feature: GZ8MTXP01EZWUU.52.33.C11.1.454.CMB.2.raw
  modified_base (270)..(270): a, c, t, g, unknown or other
  misc_feature (270)..(270): n is a, c, g, or t
  modified_base (314)..(314): a, c, t, g, unknown or other
  misc_feature (314)..(314): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagcttgggttttcctcgttgcttcttttaagaggcgtccagtgtcaggtgcagctggtggagtcggtgggggggctggtccagggcgtggggacggtccctgagactctctgtgcacgcctnggtatcacctacacgtaccatagaatcgacgacgtcggtacccncgaacggctaccgacgggtacgaagggggtcgtaggggaggttcgggggtaggtacctatttaacgtactccccgtaagtagaagtaccggggaaataaacgaaactaacgccgtaaactacggcaaaggtccgggtaccgtaagggaaccgggtccgtaattccggaacctacgtccgtaacccgaaggaacgtaaacccgaaacgttaccgggtaaaaacgtaaactttaccgggtttacccttttaaaacggaaaaccctaaaagttaaccggaaaaccgttaaccggtcccgtaaaggaacggttacgggacttaaacgggggaaccgggtaaaccgttaacgttaccggttttaaatttaaaccgttttaacggtcgggttaacggaaccggggttaagggaaaaccgggttaaccgttaacggtaaacgtttacccggtaacgaaccggtaaccccgttaaccccggggtaaaaag

SEQ ID NO: 314683 - DNA, 747 bp, Homo sapiens
  misc_feature: GZ8MTXP01B8X67.52.33.C11.1.454.CMB.2.raw
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
tcagcgcagtacgacacgaccggtgctcgatttagagtgagctcgttgggtttggggtggggagcctagctgtgctgtgggtccaggaggcagaactctgggtgtctcaccatggcctggatccctctacttcctccccctcctcactctctgcacaggctctgacggcctcctatgagctgacacacgcccacccgtcggtntcagtcgtccccaggacagacggccaggactcacctgctctggatatgcattcgaccaaacgntatgtctttagtcggtaccagacgacggaacggccccgggccaccggtccccgttggtcggttggtgtagtagtaaataacgacacgtggacgacggccccctacggacgggtaccttccccgaggtaaccgtcgttaacgtttccgtccggtcgtacccgtccggtagggtaccggaaacggggtaccctaacggtcctaaacgttacggttccggaccctaagttccggaagggttacgggacgttaccccgaagggaccgtaaggggaacggggacgggagggtactacgggtaacctttagttacggttataacctaactaccgtaaccgaacggtaacctaacccgttaagttttccgggttaacttttacgttaccgttcgttaaccgggttaccgttacggtcccggaaacccggttaaacgggttccccgtacccgggttacccggtttaacgggaaccccgtaaaccccggg

SEQ ID NO: 314684 - DNA, 683 bp, Homo sapiens
  misc_feature: GZ8MTXP01AHP6I.52.33.C11.1.454.CMB.2.raw
  modified_base (309)..(309): a, c, t, g, unknown or other
  misc_feature (309)..(309): n is a, c, g, or t
  modified_base (593)..(593): a, c, t, g, unknown or other
  misc_feature (593)..(593): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgcttctttaagaggcgtccagtgtcaggtgcagctggtggaggtcggtggggggggctggtccagggcgtggggagtccctgagtactctctgtgcagctctggacttccacctcacgtaccatagaatgctacgtcgggccnccgagtcctccgaggacgagggcgtgggaggtgggtgctacgttatactcccctatgagtagaacgaactaaataacgacaacgtacgacgagtacggtccggtaaggaccgggtaccctagttaccgacctacgtacccaccgaaggaaccaaccgtaacgacgtaaagtacttacggttactaacgtaaacaaacgtacggaaacctcggtaccgaaggaaacgtacgtcgtaacgggaaccggtaacctaacgggttacttacttttaacccgtttcgggngggtaaccggttaccgggttaaaaggcgggttaaaacccctggtaaccgttaacgaccggacccgtaaccgggttaacccctaaacgggg

SEQ ID NO: 314685 - DNA, 666 bp, Homo sapiens
  misc_feature: GZ8MTXP01CHNCE.52.33.C11.1.454.CMB.2.raw
  modified_base (318)..(318): a, c, t, g, unknown or other
  misc_feature (318)..(318): n is a, c, g, or t
  modified_base (369)..(369): a, c, t, g, unknown or other
  misc_feature (369)..(369): n is a, c, g, or t
tcagcgcagtacgacacgaccggtgctcgatttagagtgagctcgttgggtttggggtggggagcctagctgtgctgtgggtccaggaggcagaactctgggtgtctcaccatggcctggatccctctacttcctcccctcctcactctctgcacaggctctgaggcctcctatgagctgacacagcccacccgtggtgtcagtcgtccccaggacagaccggcaggatcacctgctctggagatgcattcgaccaaacgatatgtacttagttcggtaccagcagaacgccgggccgacggcccctgtcgttggtanagttagtaataagactacgtagagacggcccccttacggagggactcccgnggaaacgtcgtaacttctcggtcggtcctcccgagggtccgaacggggtacctaacgggtacaacgtagtttccgggacctaagtacgagggttcgggaacgttacccgaagggacgaagggacgggggacggacgggtaccgtaggtaacttacgtttattacggtactaaacgttaccaaacgtacgtaacctaaccgttgtttagggttaaccttagttacgttcgttaaccggttacttacggaaccgtaaccgtaacgtacccgaccggttaccgtcggttccgaaccccgg

SEQ ID NO: 314686 - DNA, 504 bp, Homo sapiens
  misc_feature: GZ8MTXP02HM9IL.52.33.C11.1.454.CMB.2.raw
  modified_base (410)..(410): a, c, t, g, unknown or other
  misc_feature (410)..(410): n is a, c, g, or t
tcagcgcagtacgacacgaccggtgctcgatttagagtgagctcgttgggtttggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaaatatgcttactggtaccagcagaagcccggcaggcccctgtcttgcttatttataaagactttgagagccctcgacgggacccctgagcgattctcctggctccagctcagcgacaacagtcacgttgaccatcagtggagtccgaggcagaggacgaggctgactattacngtcagtcagtcagacagcagtgcacttatgtcgttatcggcgtacggaccaaactcgaccgtccgtaggtacacgaccaacggcctcgcccccg

SEQ ID NO: 314687 - DNA, 550 bp, Homo sapiens
  misc_feature: GZ8MTXP02JB4NI.52.33.C11.1.454.CMB.2.raw
  modified_base (203)..(203): a, c, t, g, unknown or other
  misc_feature (203)..(203): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggganagccaccctctcctgcagggccagtcagagtgttggcaacctcttagcctggtaccaacaaaactggccaggctccagctctcatctatgatgcatccacgaggccacgtggcactcccagccaggttcagtggcaggtgggtctgagacagacttcactctcaccatcagtcgcctcgagcctagaagtatttgctagtttatactgtcagtcagcgtagcctagtcgcttcgttcgtttcgggcggtaggacctaagggttcgaaggtactacgaaaaccgtagttggtacggacctggaccaaccgtattccgttacgtccttacgtacctttcctttccccgg

SEQ ID NO: 314688 - DNA, 521 bp, Homo sapiens
  misc_feature: GZ8MTXP02JCPMQ.52.33.C11.1.454.CMB.2.raw
  modified_base (367)..(367): a, c, t, g, unknown or other
  misc_feature (367)..(367): n is a, c, g, or t
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaaatatgcttactggtaccagcagaacgccccggcacggcccctgtcttgcttatttataaagtctttagagacggccctcgacgggacccctgacgcgtattctcctggctccagctcagcgacaacngtcacgttgaccatcgagtgagtccaggcagaggacgaggctagactatactgtcagtcatcagacagcagtggactacgttatcgtcgtagttcgggacggaacggaccaaacgtcgaccgtcgtaggacacgaccaacggcctacgcccccg

SEQ ID NO: 314689 - DNA, 544 bp, Homo sapiens
  misc_feature: GZ8MTXP02JR895.52.33.C11.1.454.CMB.2.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgttggcaacctnttagcctggtaaccaacaaaacctggcaggctcccaggctcctcatctatgatgcatccacggaggccacgtggcactccccagccaggttccaggtggcaggtgggtctgagacagacttcactcncaccatcagtcgcctgagcctagaatntttgcttagtttatactgtcagcaggcgtagccacgtgctcgtcgtttcgggacggagggtaccgaggttcgaaggtactacgaaaacgtacgtggtacggactgacctaacgtagttcgtcgtcttccacttcccttccccg

SEQ ID NO: 314690 - DNA, 556 bp, Homo sapiens
  misc_feature: GZ8MTXP02GDEYX.52.33.C11.1.454.CMB.2.raw
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggcaggatcacctgctctggagatgcattgaccaaagcaaatatgcttactggtaccagcagaacgcccggccacggcccctgtctgcttatttaataaagtactttgagacggccctcgacgggacccctgagcgtattctcctgcctcagctcagcgaacaacagtcacgttgaccatcagtggacgtccaggcaagaggacgaggcagactattactgtacagtcatcaagacagcgagtcggactacttagtcgtacgtagttcggggacggtaaacgggaaccctaaaacgtcggaaacccgtccgtaacggtaccgaacggtacccgaaacgggcctacccggtacccccg

SEQ ID NO: 314691 - DNA, 539 bp, Homo sapiens
  misc_feature: GZ8MTXP02F0S7Y.52.33.C11.1.454.CMB.2.raw
  modified_base (505)..(505): a, c, t, g, unknown or other
  misc_feature (505)..(505): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccagggctggggaggtccctgagactctcctgtgcagcctctggattcaccttcagtacccatgaaatgcacgtgggtccgccaggctccaggcgaaggggctgggagtggggtggcacgttatactcccctatgatggaagcaatagcactacgcagagtccgtgaaacgggccgattgaccatctaccagaacgacaactacgaagtaaagttacggttacttactaacaaatacgaacaacgcctagagagcagaggacacggcttagtctttaagngtgacgagaggaactgatacagcaacgccctaag

SEQ ID NO: 314692 - DNA, 570 bp, Homo sapiens
  misc_feature: GZ8MTXP02J19G3.52.33.C11.1.454.CMB.2.raw
  modified_base (202)..(202): a, c, t, g, unknown or other
  misc_feature (202)..(202): n is a, c, g, or t
  modified_base (392)..(392): a, c, t, g, unknown or other
  misc_feature (392)..(392): n is a, c, g, or t
tcagcgcagtacgacacgaccggtgctcgatttagagtgagctcgttgggtttggggaggaactgctcagttaggacccagagggaaccatggaagccccagctcagcttctcttcctcctgctactctggctcccagataccaccggagaagttgtattgacacagtctccagccaccctgtctttgtctccagggggganagccaccctctcctgcagggccagtcagagtgttggcaacctcttagcctggtaccaacaaaacctggccaggctcccagctcctcatctatgatgcatccacgaggccactggcactcccagccaggttcagtggcagtggtctgagacagacttcactctcaccatcagtgcctgagcctagaacgtntttgctagtttatactgtcagcagcgtagcctagtcggtcctcgttccgtttcggggacgggtacgggtacctaaaggggttcgaaaggtacgtaaccgaaaacggtaacttgggtacggaccttcggacccaacctaacgttccttacgttacctttcaacgtttccctttcccccg

SEQ ID NO: 314693 - DNA, 645 bp, Homo sapiens
  misc_feature: GZ8MTXP02GSPS4.52.33.C11.1.454.CMB.2.raw
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcggtggggggggctggtccaggctgggaggtccctgagactctcctgtgcagcctctggattcaccttcagtaccccatcgaaaatgctaacgtcggggtcccgccgacgggcctccgaggcgaagggggcctggggaggtggggtgctacttagtatcccctatgatggaagcaaatagcactacgacagagtccgtaggaacgggccgtaattggaacctaagtcctacccgaagaacgaacaaacgtcgaaaagtaaacttaccgggtttacttaccgttaaacaaaacttacggaaacgaccgtaacgttacgaggaaacgacgacgtacgggaacgtaaccgtacggtactttaactttaccgttaaacgtggtaacgacggtaaggtaaacgggtacctaggttaactacgacgaccgtacgtaaacccg

SEQ ID NO: 314694 - DNA, 546 bp, Homo sapiens
  misc_feature: GZ8MTXP02I3JLJ.52.33.C11.1.454.CMB.2.raw
  modified_base (259)..(259): a, c, t, g, unknown or other
  misc_feature (259)..(259): n is a, c, g, or t
  modified_base (305)..(305): a, c, t, g, unknown or other
  misc_feature (305)..(305): n is a, c, g, or t
  modified_base (461)..(461): a, c, t, g, unknown or other
  misc_feature (461)..(461): n is a, c, g, or t
tcagcgcagtacgacacgaccggtgctcgatttagagtgagctcgttgggtttggggtggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaaccgntatgcttattggtaccagcagaagccggccaggcccctgtgttggngatgtataaagacactgagacggcccctgagggatcccctgacgcgtattcctcgtcggcctcccgagggtcgaaggggacaacgggttcacgaagttcggcccatccgaaggttggacgtccgaggcaggaggacgagctgactagttattgtanaaatcaacagacaacctattaggtactttaatcgttacttacggaacttgaacgacgaacgtccaccgtcgtacgggtcaaccgg

SEQ ID NO: 314695 - DNA, 502 bp, Homo sapiens
  misc_feature: GZ8MTXP02I4IOX.52.33.C11.1.454.CMB.2.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
tcagcgcagtacgacacgaccggtgctcgatttagagtgagctcgttgggtttggggaggaactgctcagttaggacccagagggaaccatggaagccccagctcagcttctcttcctcctgctactctggctcccagataccaccggagaagttgtattgacacagtctccagccaccctgtctttgctccgaggggganagccaccctctcctgccagggccagtcagagtgttgcaactntagcctgaccaanaaacngcagcnccagctcnatctatgatgcatccacgaggccatggcatcccagcccaggttcagtggcaggtgggtctgagacagacttcactctacaccatcagtcggcctcgagcctgaagtatttgctagtttntacngtcagcagcgtagccatgctcgtctttcggcggagggaccaagggttgaacgatacgaaaacggtactggtcggactgccaacgtactctgtctctctcttccg

SEQ ID NO: 314696 - DNA, 512 bp, Homo sapiens
  misc_feature: GZ8MTXP02IRR4Z.52.33.C11.1.454.CMB.2.raw
  modified_base (385)..(385): a, c, t, g, unknown or other
  misc_feature (385)..(385): n is a, c, g, or t
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaacgcccggccacggcccctgtctgcttatttataagactttgagaggccctacgacggacccctgacgcgattctctgctcagctcagcgacaacagtcacgtgacatcagtgagccgagcagnggacgaggctagactattacgtgtacagtcatacacgacagcagtgactacgttatgtacgtagttcggacggacggacaaaacgtcgaccgtaacgacggtcacggacccgagctacggtcccccg

SEQ ID NO: 314697 - DNA, 646 bp, Homo sapiens
  misc_feature: GZ8MTXP02JOAT5.52.33.C11.1.454.CMB.2.raw
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (561)..(561): a, c, t, g, unknown or other
  misc_feature (561)..(561): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggctgggaggtccctgagactctcctgtgcagcctctggattcaccttcagtacccatgaaatgcactgggtcccncaggctccgaggcaaggggctgggagtgggngctactatatccctatgatggaagcaatagcactacgcagacgtccgtaggaaagggccctaagttcgaaccatcctaccaggaacgtaaccaaacgtacgaaagtaaacgttaccgggtttaccttactaaactaaaagttacgaaaacacgtaccctaggacggtaagtccgtagggaacggtaaccgtaaccgggtaccttaagtttaccgtttttaaaccgngggttacgaccggggtaaggtaacgggggtaaaccttacggaaacgtttaccggaacggaccgtaaccggacccccgtaaaacgg

SEQ ID NO: 314698 - DNA, 518 bp, Homo sapiens
  misc_feature: GZ8MTXP02JWIY4.52.33.C11.1.454.CMB.2.raw
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaacgcccggcacggcccctgtcttgctttatttataaagtctttgagacggccctcgacgggacccctgacgcgtattctctggctccagctcagcgacaacagtcacgttgaccatcagtggagtccaggcagagacgaggctgactatactgcagtcatcagacagcagtgactacgttatcgtcgtatccgggacggacgggaacctaaacgtgacccgtcgtaacggtcaccgaccgaacggtctacgcccccg

SEQ ID NO: 314699 - DNA, 531 bp, Homo sapiens
  misc_feature: GZ8MTXP02IJ2QC.52.33.C11.1.454.CMB.2.raw
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctccagataccacggagaagttgtattgacacagtctccagccaccctgtctttgtctcgagggggganagccacctctcctgcagggccagtcagagtgtgcaactntagctgacaacaaacngcagcnccagcncnatctatgatgcatccgacgaggccatggcactcccagccgaggttcagtggcaggtgggctgagacagactcactctacaccatcagtcgcctgacgctagaagtattttgactagtttatactgtcagtcagtcgtacgcctagtcgcttcgttcgtttcgggacgggtagggaaccgtagggttgaaggacttaacgaaaacgtacgtaggtcgctcgacctaaccacgtcttacgtccttcctaacttcccttacccg

SEQ ID NO: 314700 - DNA, 519 bp, Homo sapiens
  misc_feature: GZ8MTXP02JVOOG.52.33.C11.1.454.CMB.2.raw
  modified_base (203)..(203): a, c, t, g, unknown or other
  misc_feature (203)..(203): n is a, c, g, or t
  modified_base (418)..(418): a, c, t, g, unknown or other
  misc_feature (418)..(418): n is a, c, g, or t
  modified_base (459)..(459): a, c, t, g, unknown or other
  misc_feature (459)..(459): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggganagccaccctctcctgcagggccagtcagagtgttggcaacctcttagcctggtaccaaacaaaacctggccaggctcccaggctcctcatctatgatgcatccacgaggccatggcatcccagccaggttcagtggcagtgggtctgagacagacttcactctcaccatcagtcgcctcgagcctgaacgtattttgctagtttatactgtcagnagcgtagccatgctctcgttcggcggtaggactaagggttnaacgatacgaaaacgtactggtacgcttcgacaaccgtatctcgtctcacttccctcccg

SEQ ID NO: 314701 - DNA, 567 bp, Homo sapiens
  misc_feature: GZ8MTXP02G2EFI.52.33.C11.1.454.CMB.2.raw
  modified_base (428)..(428): a, c, t, g, unknown or other
  misc_feature (428)..(428): n is a, c, g, or t
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagcggaaccaggatcacctgctctggagatgcattcgaccaaagcaaatatgcttactggtaccagcagacgcccgccaggcccctgtctgcttatttataagtctttgagacgcctcgacggacccctgacgcgattctctggctcagctcagcgacacagtcacgttgaccatcagtggacgtcgagcgagaggacgaggctagactattacgtgtacagtacatcagacncgacgtagtggactacgttagtcggttacgttagttaccgggacgggaaacggggtaccctaaaaccgttcggaacccgttcccgttaaacggtaccgaccggacccgtaaacggggtccctaacccggtaccccccgg

SEQ ID NO: 314702 - DNA, 511 bp, Homo sapiens
  misc_feature: GZ8MTXP02G9SCR.52.33.C11.1.454.CMB.2.raw
  modified_base (337)..(337): a, c, t, g, unknown or other
  misc_feature (337)..(337): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (428)..(429): a, c, t, g, unknown or other
  misc_feature (428)..(429): n is a, c, g, or t
  modified_base (431)..(431): a, c, t, g, unknown or other
  misc_feature (431)..(431): n is a, c, g, or t
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaaatatgcttactggtaccagcagaagcccggccaggcccctgtcttgcttatttataaagtactttgagaggccctcgacgggacccctgagcgattcncctggctccagctcagcgacaacagtcacgttgaccatcagtgagtcaggcagaggacgaggctagacttatactgcntcananaganagnngngcgtactatcgtcgtagtcggtacggacggacgaacgtacgaccgtaaccgtacgtacgacgaccgacgcgtccgtcccg

SEQ ID NO: 314703 - DNA, 509 bp, Homo sapiens
  misc_feature: GZ8MTXP02FN4FK.52.33.C11.1.454.CMB.2.raw
  modified_base (396)..(396): a, c, t, g, unknown or other
  misc_feature (396)..(396): n is a, c, g, or t
tcagcgcagtacgacacgaccggtgctcgatttagagtgagctcgttgggtttggggaggaactgctcagttaggacccagagggaaccatggaagccccagctcagcttctcttcctcctgctactctggctcccagataccaccggagaagttgtattgacacagtctccagccaccctgtctttgtctccgaggggggagagccaccctctcctgcagggccagtcagagtgttggcaacctcttagcctggtaccaacaaacctggccaggctcccaggctcctcatctatgatgcatccacgagggccactggcatccccagccaggttcagtggcaggtgggtctgagacagacttcactctcaccatcagtcggcctcgagcctgaagnttttgctagtttattactgtcagcagcgtagccactggctctcgtttcggcggaggaccaagggttgagatacaaacgactgtcgctgcaaccatctgtcttcactctccccg

SEQ ID NO: 314704 - DNA, 542 bp, Homo sapiens
  misc_feature: GZ8MTXP02G377Q.52.33.C11.1.454.CMB.2.raw
  modified_base (340)..(340): a, c, t, g, unknown or other
  misc_feature (340)..(340): n is a, c, g, or t
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagacgcccggcacggcccctgtcttgcttatttataaagtactttgagacggccctacgacgggacccctgacgcgattcncctgctcagctcagcgacaacagtacacgttgaccatcagtgagtcaggcagacggacgaggctagactatactgtcagtcatcagacagcagtgactattagtcgtcgtagttcgggacggaaacgggaacccaaaacgtcggtaacccgtaaccgttaacggtccgaacgacccgaaacggtcccgtaccggtccccccg

SEQ ID NO: 314705 - DNA, 576 bp, Homo sapiens
  misc_feature: GZ8MTXP02F5ZT5.52.33.C11.1.454.CMB.2.raw
  modified_base (162)..(162): a, c, t, g, unknown or other
  misc_feature (162)..(162): n is a, c, g, or t
  modified_base (304)..(304): a, c, t, g, unknown or other
  misc_feature (304)..(304): n is a, c, g, or t
  modified_base (483)..(483): a, c, t, g, unknown or other
  misc_feature (483)..(483): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttccncgttgctcttttaagaggcgtccagtgtcaggtgcagctggtggagtcgtggggggggctgggtccaggctggggagtccctgagactctcctgtgcagcctctggattcaccttcagtacccatgaaatgcactgggtccncaggatccaggcaaggggctgggagtggggtgcacgttatatcccctaatgagtaggagtacaatagcaactacgcagcgtccgtgaaagggccagttgacatctacccagacgaacaacgtacgaaagtaaagtacggttaccttactaacaaatacgaaacacgaccgtagagacgngtaggacgacgtacggtacttacttcgtttacgtcggtacgtacggaaggtaacggtaacgtacgtaacgtacgacgacgaccgaccgtaacg

SEQ ID NO: 314706 - DNA, 617 bp, Homo sapiens
  misc_feature: GZ8MTXP02JQIDQ.52.33.C11.1.454.CMB.2.raw
  modified_base (204)..(204): a, c, t, g, unknown or other
  misc_feature (204)..(204): n is a, c, g, or t
  modified_base (287)..(287): a, c, t, g, unknown or other
  misc_feature (287)..(287): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcagggccagtcagagtgttggcaactctagcctggtaccaacaaacctggcaggcctccaggctccnatctatgatgcatccacggaggcccacgtggacactccccaggcctaggttccaggtcggctagggtggggtctaggacgacacgtacttccaccttctaccaacctatcgaggttcgggccctcggacgtcccgtaggaattacgtttttgacttaggttttactacgtgtacagctaacggcgtagccctagtcgggtcttccgttcggtttcggggacgggtacgggtaaccgtaaggggttcgaaggtacgtaaccgaaaacggtcgtaggtaccgggtctacgacgtaactacgttcgtacgttcttacctacttcccgttcccg

SEQ ID NO: 314707 - DNA, 639 bp, Homo sapiens
  misc_feature: GZ8MTXP02JBC6O.52.33.C11.1.454.CMB.2.raw
  modified_base (203)..(203): a, c, t, g, unknown or other
  misc_feature (203)..(203): n is a, c, g, or t
  modified_base (246)..(246): a, c, t, g, unknown or other
  misc_feature (246)..(246): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgctccgagggggganagccaccctctcctgcagggccagtcagagtgttggcaacctntagcctggtaccaacaaaacctggccaggctcccaggctcctcatctatgatgcatccacgagggccactggcatccccagccaggttcagtggcaggtgggtctgagacagacttcactctcaccatcagtcgcctcgagcctagaacgtattttcgaccgtaagttttaactacgtggtactaacggcgtaacggccgttagccctaacgttcgggcctttccgttccggttttccgggggaccggggttaacgggggaacccgtaaaagggggtttcggaaaggtaacgttaaccgaaaacgggtaaacgttaggggttcgggaccgttcggaccgtaacccgtagttcccgtttaggtcccttttaccgaacttttcccgttacccccg

SEQ ID NO: 314708 - DNA, 541 bp, Homo sapiens
  misc_feature: GZ8MTXP02FXY2C.52.33.C11.1.454.CMB.2.raw
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (447)..(447): a, c, t, g, unknown or other
  misc_feature (447)..(447): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggctgggaggtccctgagactctcctgtgcagcctctggattcaccttcagtacccatgaaatgcactgggtccnccaggctcaggcaaggggctgggagtgggtgcactatatccctatgatcggaaanacaaananacacacgacagagtacgagagacgatagacactacacagaagaacaacacgaagaaatacgttacttactaactaaataanaacacgacagagagacgagacgacgacgactattactttacttagtacgacgaaggaaggaaacgtaacgtaactaacacgacacgacctaacg

SEQ ID NO: 314709 - DNA, 563 bp, Homo sapiens
  misc_feature: GZ8MTXP02GY9VX.52.33.C11.1.454.CMB.2.raw
  modified_base (308)..(308): a, c, t, g, unknown or other
  misc_feature (308)..(308): n is a, c, g, or t
  modified_base (462)..(462): a, c, t, g, unknown or other
  misc_feature (462)..(462): n is a, c, g, or t
  modified_base (476)..(476): a, c, t, g, unknown or other
  misc_feature (476)..(476): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctgggtccagggctggggaggtccctgagactctcctgtgcagcctctggatcaccttcagtaccccatgaaatgcacgtcgggtccnccgaggctccgaggacaaggggctgggaggtggggtggcacgttatatcccctatgatggaagacaatagccaatacgcagagtccgtgaagggccatcgacatctacagacgacaactacgaagaactacggttctactaacaaatacgaaanacgctagagagacngaaggacacggaccttagttctttacgtgtacgaccggaagaacggggaactacggaacttaacgacgtacaccgtaccctaaacgg

SEQ ID NO: 314710 - DNA, 569 bp, Homo sapiens
  misc_feature: GZ8MTXP02FQK7P.52.33.C11.1.454.CMB.2.raw
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
  modified_base (439)..(439): a, c, t, g, unknown or other
  misc_feature (439)..(439): n is a, c, g, or t
tcagcgcagtacgacacgaccggtgctcgatttagagtgagctcgttgggtttgggggtgggtccaggaggcagaactctgggtgtctcaccatggcctggatccctctacttcctccccctcctcactctctgcacaggctctgaggcctcctatgagctgacacagccaccctcggtgtctgtgtcctcaggacagacggccaggatcacctgctntggagatgcattgaccaaagcaatangcttatggtaccagcagaagcccggccacggcccctgtctgcttatttataaagtactttgagacggccctcgaacggggacccccttggacgcgtatttctccgtggcctcagctcagcgaacaaacagtccacgttgaacccatacagtggagtccaggcagaggacgaggcagacttatactgtcagtcatnacgacagcagtggactacttagtcgttcgttagttccgggacgggtaaacggggaaccaaaacgtcgaacccggttaaccgtaacggttaccgaacgaccccgtaaacgggccctaccggtcccccccgg

SEQ ID NO: 314711 - DNA, 637 bp, Homo sapiens
  misc_feature: GZ8MTXP02G9YFQ.52.33.C11.1.454.CMB.2.raw
  modified_base (201)..(201): a, c, t, g, unknown or other
  misc_feature (201)..(201): n is a, c, g, or t
  modified_base (245)..(245): a, c, t, g, unknown or other
  misc_feature (245)..(245): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccacggagaagttgtattgacacagtctccagccacctgtctttgtctccgaggggganacgcccacctctcctgcgagggccagtcagagtgtgctaacctntacgcctaggtaaccaaacaaaaccgtcggaccaggcctacccgaggcctcctacatctatgatgcactaccgacggacggccacgtggaccactccccgagccgtaggttaccgaggtcggcacggggttggggctaggacgacagtacttcacttcaccacctatcgagggtccggtccctggaccgtacctaggtaaagtttgtttttagaccgtttaaggttttaacttactggtctaggccaaggtcgttaacgcccgttacgtcggtccttcttcgggttcgggacgggtaacggtaccgtaagggttcgaagtacgtaacgaaaacggtagtcgggtacgcgtacgaactaaccgtattcgtacgttctactacgttccctaccg

SEQ ID NO: 314712 - DNA, 690 bp, Homo sapiens
  misc_feature: GZ8MTXP02JB7RU.52.33.C11.1.454.CMB.2.raw
  modified_base (189)..(189): a, c, t, g, unknown or other
  misc_feature (189)..(189): n is a, c, g, or t
  modified_base (222)..(222): a, c, t, g, unknown or other
  misc_feature (222)..(222): n is a, c, g, or t
tcagcgcagtacgacacgaccggtgctcgatttagagtgagctcgttgggtttggggtgggtccaggaggcagaactctgggtgtctcaccatggcctggatccctctacttctccccctcctcactctctgcacaggctctgaggcctcctatgagctgacacagccaccctcggtgtctgtgtcctnaggacagacggccaggatcacctgctcgtggantgcattgaccaaagcaatatgcttactggtaccagcagacgcccggcacggcccctgtcttgctttatttaataagtactttgacgacggccctcgacggacccctgacgcgtattcgtcgtcggcctcacgtctcacgtcgaccaaacgcgtaccacgttacgaacctatcgaggtacggacgtcccgaagggccaaagggacgggaaccggagtaccgtagaaccttaagttaaccgttggtaaccgtagtaccgtaagtacaacggaaccgaggacctaaagggttcggtaacgttaaaccgtttaaggtaccggtttccggtttaaacgttcccgggggaaaccgggtaaaacggggtaacccgtaaaaccggtaccggtaaacccccggttaacggttaacgggtacccgtaaaccggacccccggaaaacgggtcccccgttacccgggttaacccccccgg

SEQ ID NO: 314713 - DNA, 516 bp, Homo sapiens
  misc_feature: GZ8MTXP02JVITQ.52.33.C11.1.454.CMB.2.raw
  modified_base (204)..(204): a, c, t, g, unknown or other
  misc_feature (204)..(204): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (465)..(465): a, c, t, g, unknown or other
  misc_feature (465)..(465): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgttgcaactctagctgtaccaacaaacctgcagctccagcnctnatctatgatgcatccacggacggccacgtggacactccccgagcctaggttcagtggcaggtgggtctaggacgacgagtactcactctacaccatcagtcggcctgagcctagaagttagttttgactagtttactactgtacagcaagcgtagcacgtgcttctcgttggcgaggactagggtnagactacaaacgactggtacgctagctaacatctgtacctctactctcccg

SEQ ID NO: 314714 - DNA, 589 bp, Homo sapiens
  misc_feature: GZ8MTXP02FV6E7.52.33.C11.1.454.CMB.2.raw
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagcccaccctcggtgtctgtgtcctcaggacagacggcaggatcacctgctctggagatgcattcgaccaaagcaaatatgcttactggtaccagcagaacgcccggcacggcccctgtcttgcttatttataaagtactttgagacggccctacgacggacccctgacgcgattctctggctcagctcagcgacaacagtacagttgaccatacgagtggacgtaccgaggcaggacggacgaagggctagaacttattaaccgtgtacagtcatccaagacagcgtaaggtggactaacgtttagtacggttacgttacggttacggggacggtaaccggggtaaccctaaaacgttcggaacccgttaaccggtaaacggtaccgaacggaccccgtaagggtcccgtacgtcccccccgg

SEQ ID NO: 314715 - DNA, 755 bp, Homo sapiens
  misc_feature: GZ8MTXP02F7UHS.52.33.C11.1.454.CMB.2.raw
  modified_base (204)..(204): a, c, t, g, unknown or other
  misc_feature (204)..(204): n is a, c, g, or t
  modified_base (702)..(702): a, c, t, g, unknown or other
  misc_feature (702)..(702): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagcccaccctctcctgcgagggccagtcagagtgttggcaacctcttagcctaggtaaccaaacaaaaccgtggaccaggcctcccgaggcctcctcatctatgatgcactcccgacggacggccaacgtcggacctacgtccccagtccgtaggttcgaggtggacgtagggtcggggtctaggaacgactacgtaccttccgaacctcctaccaaccctattaccggacgggttccggaccccgttacggaacccggtacccgttaagggtaaaacgttttacgtttttacggaccgttttaaggtttttaaacttacgtacggttaccaaggtccgtaacgggtcgggttaaacccgcccgttaacgggttccggtcccgtttacggtttcccggggttacgggggaacggggtacgggtaaaccggtaaggggttaagaacgtaacgtaaaccgtaaaacgggtacgtcgggtaccggtacgtaccggtaaccnccggttaacttccgtttacgttacctttaccgtacccgtttccccgttacccg

SEQ ID NO: 314716 - DNA, 633 bp, Homo sapiens
  misc_feature: GZ8MTXP02GMFPK.52.33.C11.1.454.CMB.2.raw
  modified_base (305)..(305): a, c, t, g, unknown or other
  misc_feature (305)..(305): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtgggggggctggtccaggctgggaggtccctgagactctcctgtgcagcctctggattcaccttcacgtacccatagaaatcgcacgtggtccncgaggcctccgaggcgaaggggctagggagtgggtgactacgtatacgtccctagtgagtacggaagactaaatacgcaacgtaacgcgaaggtacgtccggtaggaaacgggtcccgaagttcgaaccattaccaccgaagaacgacaaactacgaaaacgtaaacgttaccggtttacttaacaactaaaagtcgaaactacgaccgtaggaagacgcgtacggacggaaccgtacggtacttacgtttacttttaacggacggtacggacgtaacgggtaacggtaaccgtacgtaacgtacgacgaccgtaccgtaccgtaacg

SEQ ID NO: 314717 - DNA, 573 bp, Homo sapiens
  misc_feature: GZ8MTXP02H5GKO.52.33.C11.1.454.CMB.2.raw
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggactcacctgctctggagatgcattgaccaaagcaaatatgcttactggtacagcagacgcccgcacggcccctgtctgcttattataaagtcttgagacggcctcgacggaccctgacgcgattctcgtggcctcagtctacgacgcgaacaactacgtacacgttcgaaccctagtccgaggtcggacgtcccgaagggccgagggaacgggacggaggccgtagtaacttagtttaaccgtggtactagtaccagtacaagacagtcaaggtcgactacttagtcggttacgttagttcgggacggtaacggtaacccaaacgtcgaaccgtcgtacggacacggaccacggcctaccgcccccg

SEQ ID NO: 314718 - DNA, 648 bp, Homo sapiens
  misc_feature: GZ8MTXP02HGG7D.52.33.C11.1.454.CMB.2.raw
  modified_base (203)..(203): a, c, t, g, unknown or other
  misc_feature (203)..(203): n is a, c, g, or t
  modified_base (425)..(425): a, c, t, g, unknown or other
  misc_feature (425)..(425): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggganagccacctctcctgcagggccagtcagagtgttggctaacctcttagcctggtaccaaacaaaacctggaccaggcctcccgagcctcctcatctatgatgcatccacgacggccactggacactccccgagcctacggttcaaggtggacagggttcgggtctaggagactagacttcactctaccacctatcgaggtcgccctcgacgcctaggtaagtnttttacgcttaagtttacttaacgtcgtaccaaggtccaggtaccgtagtcccctaacggttcggaccctttccgttccgggtttcggggaaccgggggtaacgggtaacccgtaaaaggggttggaaacgtaacgttaccgaaaaacggttacggtcgggttacgccgttcggaccaaccgtactccgttacgtcctttacgtaacctttccgttacccccg

SEQ ID NO: 314719 - DNA, 525 bp, Homo sapiens
  misc_feature: GZ8MTXP02H6IM6.52.33.C11.1.454.CMB.2.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (279)..(281): a, c, t, g, unknown or other
  misc_feature (279)..(281): n is a, c, g, or t
  modified_base (286)..(286): a, c, t, g, unknown or other
  misc_feature (286)..(286): n is a, c, g, or t
  modified_base (289)..(290): a, c, t, g, unknown or other
  misc_feature (289)..(290): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (503)..(503): a, c, t, g, unknown or other
  misc_feature (503)..(503): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagngtgttggcaactnttagcctgaccaanaaactgcagcnccagcncnnnctatnatnnatcacgnggccangcatcccagcaggtcagtggcngtggtctgagacagacttcactctcacctatcagtcggcctcgacgtccgtagaacgtatttttgacttagttttatacgttgtcagctagtcgtaagcctacgtcggcttctcgtttcgggacggtacgggacctaagggttcgagtataacgaaacgtacgtggtacgctgcaacngtctcgtctctacttcctcccg

SEQ ID NO: 314720 - DNA, 591 bp, Homo sapiens
  misc_feature: GZ8MTXP02IZ35R.52.33.C11.1.454.CMB.2.raw
  modified_base (241)..(241): a, c, t, g, unknown or other
  misc_feature (241)..(241): n is a, c, g, or t
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctctggagatgcattgaccaaacgntatgcttatggtacagcagagccggcacggccctgtgtggtgatgataaagacacgtagagacggccctacgagggactcccgtagacgcgtacttcctcgtcggcctccgaggtcgacgggacgtaacggttactagttacgcctagtacgaggtacggacgtccgagacgaggaacggacggaggctagtacttagttacttagtactaaatacaaacgacgacacctagtttacggtattagttagttcgttacgaacgtacgtacgaacgtacggtacgtccgtacgtcggaccgtacgaacccgaaccgaacccgacctaccgtacgtacctaccttcgttcccg

SEQ ID NO: 314721 - DNA, 604 bp, Homo sapiens
  misc_feature: GZ8MTXP02JLI0Z.52.33.C11.1.454.CMB.2.raw
  modified_base (203)..(203): a, c, t, g, unknown or other
  misc_feature (203)..(203): n is a, c, g, or t
  modified_base (425)..(425): a, c, t, g, unknown or other
  misc_feature (425)..(425): n is a, c, g, or t
  modified_base (465)..(465): a, c, t, g, unknown or other
  misc_feature (465)..(465): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccagggggganagccaccctctcctgcagggccagtcagagtgttgcaactcttagcctggtaaccaacaaaacctggaccaggcctcccaggctcctcatctatgatgcatccacggaggccacgtggcactcccagccgtaggttcaggtggctaggtcggggtctagacgacagtacttcacttctaccacctatccgaggttcggaccctcggacgtccgtagaagttnttttagacttagttttactactgtacagtcgaggcgtacnccgtacgtcgtctcgttcgtttcggggacggtagggtaccgtaagggttcgaaacggtactaacgaaaaacggtcgttacggtcgaccgttacgcctaaccgtattccgtacgttccttactacgttcccgttaccccg

SEQ ID NO: 314722 - DNA, 658 bp, Homo sapiens
  misc_feature: GZ8MTXP02FL2PT.52.33.C11.1.454.CMB.2.raw
tcagcgcagtacgacacgaccggtgctcgatttagagtgagctcgttgggtttggggtggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgcttatggtaccagcagagccggcaggcccctgtgtggtgatgtataaagacactgagaggccccctcgaggggactcccgtgacgcgtacttctctggcctccgagggttccgaacggggaccaaacgggtccaacgtagttcgggccctaagtccgaggttgggacgtacccgaaggggccgaagggacgggaacggagggacctagggtaaccttaagtttagtttacggtacctaaaattaccaaaacctaacggaacctaaacccgttaagtttacgggttaaaccttttaagtacgtttaccgtttaccggaacgtttacggaaccgtaaacccgtaaacggttaccctaaccccgggttcccgttacgggggttacccaaaccccggg

SEQ ID NO: 314723 - DNA, 556 bp, Homo sapiens
  misc_feature: GZ8MTXP02F4Y3X.52.33.C11.1.454.CMB.2.raw
  modified_base (436)..(436): a, c, t, g, unknown or other
  misc_feature (436)..(436): n is a, c, g, or t
  modified_base (461)..(461): a, c, t, g, unknown or other
  misc_feature (461)..(461): n is a, c, g, or t
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaacgcccggcacggcccctgtcttgcttattataaagtacttgagacggccctcgacggacccctgacgcgtattctccgtggcctccagctacgacgccgaacaaacgagtacctacgttacgacctatcgaggttggacgtccaggcaggaggacgaggctagacttattacngtacagtcatcaagacagcgtaggngactacgttatcggtacgttagtcggacgggtacggacctaaaacgtcggacccgtaacgtaggtccgaacgcccgaacggccctccgtcccccg

SEQ ID NO: 314724 - DNA, 546 bp, Homo sapiens
  misc_feature: GZ8MTXP02GKAJL.52.33.C11.1.454.CMB.2.raw
  modified_base (204)..(204): a, c, t, g, unknown or other
  misc_feature (204)..(204): n is a, c, g, or t
  modified_base (417)..(417): a, c, t, g, unknown or other
  misc_feature (417)..(417): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgttggcaactctagcctggtaccaacaaaacctggccaggctcccaggctcctcatctatgatgcatccagaggccactggcatcccagccaggttcagtggcaggtgggctgagacagacttcactctcaccatcagtggcctcgacgcctagaagtattttgctagtttatactgtcagnaagcgtagcctagtcggcttcgtcgtttcggggacgtagggaccgtaagggttcgaagattaccgaaaacgtaacgtggtacgactcggaccaacgtactcgttcgtccttactacttcccttaccccg

SEQ ID NO: 314725 - DNA, 574 bp, Homo sapiens
  misc_feature: GZ8MTXP02ICCFD.52.33.C11.1.454.CMB.2.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggganagcccaccctctcctgcagggccagtcagagtgtgcaactntagcctgacaacaaactgcagcnccagctcncatctatgatgcatccacggaggccactggccatcccagccaggttcaggtggcaggtggtctgagacagcttcactctcaccatcagtcgcctcgagcctgaatattttgcttagttttattactgtcagtccagcgtacgcctacgtcggccttcgttcgtttcggggacgggtacggggtaaccgtaaagggttggaaacgtaagttaaccgaaaaacggtaaacgtcggttacgggtccttggaccaacccgtatttccgttcggttcctttacctaactttccctttacccccg

SEQ ID NO: 314726 - DNA, 614 bp, Homo sapiens
  misc_feature: GZ8MTXP02JXNPN.52.33.C11.1.454.CMB.2.raw
  modified_base (465)..(465): a, c, t, g, unknown or other
  misc_feature (465)..(465): n is a, c, g, or t
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcactgctcgtggagatgcattgaccaaagcaaatatgcttactggtaccagcgagaacgcccggccacggcccctgtcttgtactttatttaataaagtactttagagacggccctcgacgggacccctgacgcgtacttcgtcctcggcctccgacgctcgagccgaacaaacacgtacgacgttacgaacctagtccgtaaggttacggacgtcccgaggacgaggacgggaccgaggctagaacttagttacgngtacgtagtcatacgacgacgagtcaaggtcgtacttacgttagtcggtaccgttaggtccggggacgggtaaacgggaaacccaaacggttcgaacccggttccgtaagggtcccacggtacccgaacgggtcctcccggtacccccg

SEQ ID NO: 314727 - DNA, 621 bp, Homo sapiens
  misc_feature: GZ8MTXP02JU192.52.33.C11.1.454.CMB.2.raw
  modified_base (379)..(379): a, c, t, g, unknown or other
  misc_feature (379)..(379): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggcgtgggaggtccctgagactctcctgtgcagcctcgtggattcaccttcacgtacccatcgaaatcgcacgtgggtccgccgaggcctccgaggcgaagggggctggggaggtggggtgacgtacttatatcccctagtgatagggaanacgaaatacgcaactacgacagacgtccgtaggaacggggacccgtattacgaccactcgtaccaagaacgaacaacgtacgaaagtaaacgtacggtttacttactaacaaatacgaaacagcctagacgacgactaggacggtaacgacggtacttacgttacttttacgtggtacgtaccggaaggtaacgggtaacgtacggttaattacccgaagcccgtaacgaccccgtaaacgg

SEQ ID NO: 314728 - DNA, 659 bp, Homo sapiens
  misc_feature: GZ8MTXP02HTHP2.52.33.C11.1.454.CMB.2.raw
  modified_base (266)..(266): a, c, t, g, unknown or other
  misc_feature (266)..(266): n is a, c, g, or t
  modified_base (457)..(457): a, c, t, g, unknown or other
  misc_feature (457)..(457): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcacatggagtttgggctgagcttgggttttcctcgttgctcttttaagaggcgtccagtgtcaggtgcagctggtggagtcgtggggggggctggtccgaggcgtgggaggtccctgagactctctgtgcagcctcnggattcaccttacagtaacccatacgaaatcgcaacgtgggccccgccaaggcctccgaggacgaaggggctgggaggtggggtaggctaacgttatactcccctaagttagagtaggaaggtacaaaattacggacaaactaacgaccaggacgtaccgtaggaaacgggtacccggaattcgaacctanccgtaccaaggaaacacaaacaccgaaagtaaacgtacggttacttactaaacaaatagaaacagacctaggaagagaccttagacgggaacaacgggtacctttaagttacctttttaaagagttacggaaccggtaaggaacggggtttaaaaccgcgtaaaactttacgaaacggtcaaccgttacccccgtaaaacgg

SEQ ID NO: 314729 - DNA, 561 bp, Homo sapiens
  misc_feature: GZ8MTXP02JJLDO.52.33.C11.1.454.CMB.2.raw
  modified_base (303)..(303): a, c, t, g, unknown or other
  misc_feature (303)..(303): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggctgggaggtccctgagactctcctgtgcagcctctggattcaccttcagtacccatgaaatgcactgggtccncgaggctccgaggcagggctgggagtgggtgcatatatcccctatgataggagacaatacgcaacgtacgcagagtaccgtgaaacgggctagttcgaccatctccagacgacaacgtacgaaagtagtacggttcttactaacgaaatcgaaactagacctaggacgacgctaggcgaacgacggtacctagttcctttaacggcggtacgacggtaggacggtaacgtacgtacgtacgacgacgtacgacgtacg

SEQ ID NO: 314730 - DNA, 525 bp, Homo sapiens
  misc_feature: GZ8MTXP02GH9XA.52.33.C11.1.454.CMB.2.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
  modified_base (393)..(393): a, c, t, g, unknown or other
  misc_feature (393)..(393): n is a, c, g, or t
  modified_base (424)..(424): a, c, t, g, unknown or other
  misc_feature (424)..(424): n is a, c, g, or t
tcagcgcagtacgacacgaccggtgctcgatttagagtgagctcgttgggtttggggaggaactgctcagttaggacccagagggaaccatggaagccccagctcagcttctcttcctcctgctactctggctcccagataccaccggagaagttgtattgacacagtctccagccaccctgtctttgtctccagggggganagccacctctcctgcagggccagtcagagtgttggcaactnttagcctggtaccaacaaaacctggccaggctcccagctcctnatctatgatgcatccacgaggccatggcatcccagccaggttcagtgcagtgggtctgagacacggacttcgacttctcaccatcagtcgcctcgagcctagaagtnttttgctagtttatactagtcagcagcgtanccatgctgtcgtcggacggaggacgtaggtgacgtactacgaaacgtacgtcggtacgcgtacgacaacgtacttacgtctcgttacactttcccgtaccg

SEQ ID NO: 314731 - DNA, 573 bp, Homo sapiens
  misc_feature: GZ8MTXP02G3UP0.52.33.C11.1.454.CMB.2.raw
  modified_base (204)..(204): a, c, t, g, unknown or other
  misc_feature (204)..(204): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (401)..(401): a, c, t, g, unknown or other
  misc_feature (401)..(401): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgttggcaactcttagcctggtaccaacaaaacctggccaggctccaggctccncatctangatgcatccacgacggccacgtggcatcccagccaggttcagtggcaggtgggtctgagacagacttcactctcaccatcagtcggcctcgacgcctagaaacgtnttttgacttaagttttattacgtgtcaggctagcgtacgcctacgtggtccttcgttccgtttcggggacggggtacgggaaccgtaaggggttcgaaacgtacgttaacgaaaacgtacgttggtacgggacttgactaacctagttctcgtccttacacttccgtccccg

SEQ ID NO: 314732 - DNA, 560 bp, Homo sapiens
  misc_feature: GZ8MTXP02ICZ31.52.33.C11.1.454.CMB.2.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganacgcccaccctctcctgcagggccagtcagagtgttggcactnttagctgaccaacaaactgcagcncagcncnatcangatgcatccagnggaccaagngcntccagcagtcagtggcaggtggtctagacgactagcttcacctctaccacctatcgagtcgcccgttagacgtcctagtaaagttcttttggctttaagttttaactacgtgtacagtccgagtccgttagcctagtcgtccttcgttcgttcggggcgggtacggaccgtaagggttagaacgtacgttacgaaaacgttacgtcggtcgacttgacctaactagtcgttctacttctacgttcctaccccg

SEQ ID NO: 314733 - DNA, 632 bp, Homo sapiens
  misc_feature: GZ8MTXP02JUCRP.52.33.C11.1.454.CMB.2.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (391)..(391): a, c, t, g, unknown or other
  misc_feature (391)..(391): n is a, c, g, or t
  modified_base (419)..(419): a, c, t, g, unknown or other
  misc_feature (419)..(419): n is a, c, g, or t
tcagcgcagtacgacacgaccggtgctcgatttagagtgagctcgttggggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganagccaccctctcctgcagggccagtcagagtgttggcaactcttagcctggtaccaaacaaaacctggccaggcctcccaggctccncatctatgatgcatccgacggacggggcccacgtggccactccccagcccagggttccaggtcggcaggtgggtctggagacagacttcactctccacntcgagtcgccctgacgcctagaacgttntttttgacttaaggttttacttacgtgttacagcgtaggtccgtagtcccacggttcgggcctttccgtttcggtttaccgggggacgggtaacggggtaaccgtaagggggttacaacggtaactaaccggaaaacggtacgttgggtacgggcctacggaccaacccgttagttcccgttgttacctttacctaccttcccgtttaccccg

SEQ ID NO: 314734 - DNA, 662 bp, Homo sapiens
  misc_feature: GZ8MTXP02HFZYI.52.33.C11.1.454.CMB.2.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagcttgggttttcctcgttgctcttttaagaggcgtccagtgtcaggtgcagctggtggagtcggtggggggggctggtccgaggcgtgggacgtccctgagactctcctgtncagcctntggatcaccttcacgtacccatgaaatgcacgtcgggtcccgccgacggcctccgaggcgaacggggcgtggggaggttggggacggctacgttatacgtacccctagtagagtaggagactaagtagcaactacggacaaggtacgtaccggtaggaaaccggggtccgtaacttacggaaccctatacccgtaccgaaagacggaaaccaaacgtacgaaaagtaacgttaccggttactacgtaacaaacgttacggaaaccacggacctaggagaccgtgtacggaaggtaccgtaccggtattacgtttaccgtttaacggacggtacggtacggtaacggtaacggtaacgtacgtaacgtacgacgaccgtaaccggtaccgtaacg

SEQ ID NO: 314735 - DNA, 605 bp, Homo sapiens
  misc_feature: GZ8MTXP02J02HS.52.33.C11.1.454.CMB.2.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgctccgaggggganagccacctctcctgcagggccagtcagagtgttggcaacctntagcctgtaccaanaaactgccagctccagctcncatctatcgatgcactccgacgaggccaacgtggcacgtccccagacccgtaggttccaggtggaccgaggtggggtctgaacgacagtactcgactcctacacatcagtcggcctcganccgtagaatntttgactagtttatacgtntacngcagtcgtancctacgtggcttccgttcgtttaccggacgggtaacggtaccgtaaaggtttcggaacgttaaacgtaccgaaaaccggtacttgggggttaccgaccgttacggtacccgaaacccgtttacgttccgttacgttaccgttaccgtacccgttccttaccccg

SEQ ID NO: 314736 - DNA, 627 bp, Homo sapiens
  misc_feature: GZ8MTXP02HFGC2.52.33.C11.1.454.CMB.2.raw
  modified_base (302)..(302): a, c, t, g, unknown or other
  misc_feature (302)..(302): n is a, c, g, or t
  modified_base (567)..(567): a, c, t, g, unknown or other
  misc_feature (567)..(567): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggctgggagtcctgagctctctgtgcagcctctggattcaccttcacgtacccatgaaatgcacgtcgggtccnccaggctccgaggcgaaggggctgggagtgggtggctacgttagtatcccctatgatggaagacaatagcacgtaacgcaggtacgtacccggtaggaaacggggtcctaaagttcgaaccctatcccgttacccaggaacgaacgaaacttacggaaagtaaacgttaccggtttacttacttaaacgaaaattacggaaaccaacgtcctaggaacgacgacctagggaacgacgaacggttcttaaatttccgtttaaccgngtcgaaccggaggtaacggtaacgtacggtaacttacgaacgccgaacgcccgtaaacgg

SEQ ID NO: 314737 - DNA, 582 bp, Homo sapiens
  misc_feature: GZ8MTXP02FKRBK.52.33.C11.1.454.CMB.2.raw
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (277)..(278): a, c, t, g, unknown or other
  misc_feature (277)..(278): n is a, c, g, or t
  modified_base (292)..(292): a, c, t, g, unknown or other
  misc_feature (292)..(292): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganacgcccaccctctcctgcagggccagtcagagtgtgcaactntagctgacacaaacngcngcncngctcnatnntgatgcatcgacgnggcactgcactcccagccaggtcagtggcacggtggctggacactacgacttcactccgtcaccagttcagtcggtaccctcgacgtaccgtagtaagttagtttacgctttagtttacttactagtacaagtcccgaaggtccgtagtacccgtacgtcgtccttcgttccgtttacgggggacggtaacgggtaccgtaaagggttcgaaagtacgtaaacgtaaacgtaaccggtggtcggtctacgacctaacgtattcgtcttcttacctacgtcccttaacccg

SEQ ID NO: 314738 - DNA, 558 bp, Homo sapiens
  misc_feature: GZ8MTXP02IU9IJ.52.33.C11.1.454.CMB.2.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagactaccaccggagaagttgtattgacacagtctccagccaccctgtctttgtctccgaggggganacgccacctctcctgcagggccagtcagagtgtgcaactntagctgtacaacaaactgcagctccagctcnatctatgatgcatccgacggtcggaccacgtggcactcccgagtccaggttcagtggcgtaggtgggtcctagacgactagtaacctcaactcaccaccatcgagttcgccctagacgtcctaagagttatttggacttaagttttactaccgtgtactagctagcgtagcccagtcgtctccgttacggttcggacgggtacggacgtaaggtcgagtactaacgaaacgtagttgacgtactacgacctaaccgtattctcgtcttaacgtcttactcccg

SEQ ID NO: 314739 - DNA, 761 bp, Homo sapiens
  misc_feature: GZ8MTXP02JDPS9.52.33.C11.1.454.CMB.2.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (296)..(296): a, c, t, g, unknown or other
  misc_feature (296)..(296): n is a, c, g, or t
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctggtgtctgtgtcctcaggacagacggccaggatcacctgctctgganatgctattcgaccaaagcaaatntgcttactggtaccngcaagacgcccggcacggccctgtcttgcttatttanaaagtctttgaggacggccctcgacggggaccctgacgtcgtacttcctccgtcgggacctccgaacggtccttaccgaacggcccggaaacaaaccgtacggttaccgtaaccgtttacggaaacccctaagtttacccgaggggttacggttaaccggtccggaaacgggggacgaaaacggggacgggggaaacggtaacggggtacccttaagggtaaaccttttaacgttaaaccgtttgggaccctaaaggttaccctaattaccgaaacgggacaacggttacgaaaggggtttcggaacctttaacgtttaagtcgggttacggttaacggttccgggggaaacgggaacccggggttaaaccaaaaaccggtttcggaaaacccccggtccgtttaaacgggtacccgtaaaccggtaccccggaaacgggtccccgtaaccggttacccccccgg

SEQ ID NO: 314740 - DNA, 634 bp, Homo sapiens
  misc_feature: GZ8MTXP02FM5A1.52.33.C11.1.454.CMB.2.raw
  modified_base (294)..(294): a, c, t, g, unknown or other
  misc_feature (294)..(294): n is a, c, g, or t
  modified_base (320)..(320): a, c, t, g, unknown or other
  misc_feature (320)..(320): n is a, c, g, or t
  modified_base (386)..(386): a, c, t, g, unknown or other
  misc_feature (386)..(386): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagtcttgggttttcctcgttgcttcttttaagaggcgtccagtgtcaggtgcagctggtggagtcggtgggggggcgtggtccgagggcgtggggacggtcccgtgacgtactctccgtgtgcacgcctcgtggacttcaccgttnacgtacccatgaaatgcacgtggccncaggcctccgaggcgaaggggctgggagtggggtcgctagttatagtccctagtgacgtaggaaanacaaagtacactaacgtacgacgacgtacggtacggtaggaacggtacgtacgtacgacctacgtaccacgaacgaacgaacaacgtaaacgtaacgttaaacgttaccgttaacttaacgtaaactaagtacgaacacgtacgtagacgacgacgtagacggacgtacgtacttagttacgttacgtacggtacgacgtaaggaacggtaacgtacgtaacgtacgacgaccgtaccgaccgtaacg

SEQ ID NO: 314741 - DNA, 509 bp, Homo sapiens
  misc_feature: GZ8MTXP02FO3GB.52.33.C11.1.454.CMB.2.raw
  modified_base (151)..(151): a, c, t, g, unknown or other
  misc_feature (151)..(151): n is a, c, g, or t
  modified_base (203)..(203): a, c, t, g, unknown or other
  misc_feature (203)..(203): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccgganaagttgtattgacacagtctccagccaccctgtctttgtctccagggggganagccaccctctcctgcagggccagtcagagtgttggcaacctcttagcctggtaccaacaaacctggccaggctccccaggctcctcatctatgatgcatccacgagggccactggcatcccagccaggttcagtggcagtggggtctgagacagacttcactctcaccatcagtggccctcgagcctgaagattttgctagtttattactgtcagcagcgtagccactggctctctttcgggcgagggaccaaggttcgagatcaaaacgaactgtggctgcaaccatctgtcttcatctccccg

SEQ ID NO: 314742 - DNA, 622 bp, Homo sapiens
  misc_feature: GZ8MTXP02IOKUN.52.33.C11.1.454.CMB.2.raw
  modified_base (554)..(554): a, c, t, g, unknown or other
  misc_feature (554)..(554): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgcttcttttaagaggcgtccagtgtcaggtgcagctggtggagtcgtggggggggctggtccaggctgggaggtccctgagactctctgtgcagcctctggacttcaccttcagtacccatgaaatgcacgtcgggtcccgccaggcctccgagggcgaagggggcctagggaggtggggtggctattatactcccctatgagtggaagacaatagcaactacgcaagcgtaccggtaggaaacggggtccgtaagttcgaacctatccgtaccgaagacgaacaacgtacgaaagtaacgttacgtttactactaacgaaatacggaaactagaccgtaggaacgaggactaggaacgaacacgggtacttatttccgtttaaacgnggttacggcggtaaaggacgggtaacctacgtaaacgttcgaacgtccgtaaccgtacccgtaaacgg

SEQ ID NO: 314743 - DNA, 718 bp, Homo sapiens
  misc_feature: GZ8MTXP02FQR1A.52.33.C11.1.454.CMB.2.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
  modified_base (383)..(383): a, c, t, g, unknown or other
  misc_feature (383)..(383): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtncagctggtggagtcgtggggggggctggtccaggctgggaggtccctgagactctcctgtgcagcctctggattcaccttcacgtacccatagaaatgcacgtcgggtcccncgaggcctaccgaggacgaaggggctgggaggtggggtcgactacgtttatactcccctagtcgagtagggaaancctaaaatacggactaacgtacgacgaggtaacgtcccgggtaaggaaacggggcctaagttacgaccctattccgtacccaaggtaacgaaccgtaaacgtacgaaaaggttaaacgtttaccgggttacctttaaacctaaacgaaaagttacggaaaacctacggaccgtagaacggtacgaccgttaaggaacgggtaacccgaacgggttacctttaaactttcccgtttttaaaggtcggttacgggaccggtaagggtaaacgggggttaacccttaacggttaaagttaacccgacgggacctaacccggtacccgttaaaaaccgg

SEQ ID NO: 314744 - DNA, 749 bp, Homo sapiens
  misc_feature: GZ8MTXP02GX1NY.52.33.C11.1.454.CMB.2.raw
  modified_base (201)..(201): a, c, t, g, unknown or other
  misc_feature (201)..(201): n is a, c, g, or t
  modified_base (616)..(616): a, c, t, g, unknown or other
  misc_feature (616)..(616): n is a, c, g, or t
  modified_base (633)..(633): a, c, t, g, unknown or other
  misc_feature (633)..(633): n is a, c, g, or t
  modified_base (712)..(712): a, c, t, g, unknown or other
  misc_feature (712)..(712): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctccagataccacggagaagttgtattgacacagtctccagccacctgtctttgtcgtcgagggggganacgccacctctcctgcgagggccagtcagtagtgttcggactaaccttcgttacgcctaggtaaacccaaacgtaaaaaccgtcggacccgacggaccctaccccgagggtcccttaccctactaacttccttaagtaggtaacttcggacctaacgtacccggaaaccggggacggggacccctaaccggtcgggaccctaaccgttacccccggaacggtaccccggttaaacgggtttccgaaggggttcgggaccgtaaggggtttcggggtacctaggaaacggtacgtaacggttaccttccaccttacctacctaaccctagttacgacggttcgggtaccccttacggaaccggtaccgtaaggttaaatttcgtttttacgacgtttaagtttacttacgtcgtanacgtcgagtccggtacnccgtagtcggtaccttcgtacggttcggacgggtacggaacgtaggtacgacgactaacgaaacgagttcggagtaccngacccaagtacttcgtactcgtacctcgttcctaccg

SEQ ID NO: 314745 - DNA, 698 bp, Homo sapiens
  misc_feature: GZ8MTXP02F7RSM.52.33.C11.1.454.CMB.2.raw
  modified_base (316)..(316): a, c, t, g, unknown or other
  misc_feature (316)..(316): n is a, c, g, or t
  modified_base (369)..(369): a, c, t, g, unknown or other
  misc_feature (369)..(369): n is a, c, g, or t
tcagcgcagtacgacacgaccggtgctcgatttagagtgagctcgttgggtttggggtctgggagacgagccaagcactggaagtcgccggtgtttccattcggtgatcatcactgaacacagaggactcaccatggagtttgggctgagctgggttttcctcgttgctcttttaagaggcgtccagtgtcaggtgcagctggtggaggtcggtggggggggctggtccgagggcgtggggacggtccctgagactctcctgtgcagcctctgtatcaccttcacgtacccatagaaatcgctacgtcgggtcccncaggcctcgaggcgaaggggctgggacgtggggtgctacttagtactccctangagtaggaagacaaatacgccaacgtacgacgacggacgttcccgggagggaaacgggggccctaagttaccggaaccctacgttaccctacccggaagaaacgtaaaccgtaaaaccggttaccggaaaagttaaaccggtttaacccggtttactttaaaccgtaaacctaaaagttccgaaaaaccgccggtaacccttagggtaaacgacggtactacgggtaacggaaccccgtaggttactttaaacgttccgttttaaacgtggtacggtaccggaggtaacggtaacctaggtaatacccgagtccacggaccctaaacgg

SEQ ID NO: 314746 - DNA, 532 bp, Homo sapiens
  misc_feature: GZ8MTXP02ILNGH.52.33.C11.1.454.CMB.2.raw
  modified_base (435)..(435): a, c, t, g, unknown or other
  misc_feature (435)..(435): n is a, c, g, or t
  modified_base (462)..(462): a, c, t, g, unknown or other
  misc_feature (462)..(462): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggctggtccaggctgggaggtccctgagactctctgtgcagcctctggattcaccttcagtacccatgaaatgcactgggtcgccaggctcaggcaaggggctggaggtgggtggcacttatagccctatgatgagcaatagcactagcagagtccgagaaagccgattgaccatcgtaccagacgaacaactacgaagtaaatacggttatacctaanaaactaggaaactacgaccgtagacgngactagaggaacaggtactatactttaactgtacgacgagaggaacgtcgaagttacagcacgcctaacg

SEQ ID NO: 314747 - DNA, 607 bp, Homo sapiens
  misc_feature: GZ8MTXP02HS2YD.52.33.C11.1.454.CMB.2.raw
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (246)..(246): a, c, t, g, unknown or other
  misc_feature (246)..(246): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (278)..(280): a, c, t, g, unknown or other
  misc_feature (278)..(280): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccacggagaagttgtattgacacagtctccagccaccctgtctttgtctccgagggggganagccaccctctccngcagggccagtcagagtgttggcaacctntagcctgaccaacaaactgcngcnccngctcnnnctangatncntcacgaggcactggcactcccagcctggtcaggtggcgaggtgggtctgacgacacgtacttcgaactcttacacctatcgaggttcggcccttacgacgtcctaggaaacgtttagtttttacggcctttaagtttttaacttacttaggttaccagggtcaaacggtcgtttaacgcccgttacgtcggtctttccgttcggtttccggggcggtaacggggtaaccgtaagggtttagaacgtacgttaaccgaaaacgtacggttacggcgggtctacggctaacctagtcgttctctttcactttccgtccc

SEQ ID NO: 314748 - DNA, 627 bp, Homo sapiens
  misc_feature: GZ8MTXP02HOFL9.52.33.C11.1.454.CMB.2.raw
  modified_base (190)..(190): a, c, t, g, unknown or other
  misc_feature (190)..(190): n is a, c, g, or t
tcagcgcagtacgacacgaccggtgctcgatttagagtgagctcgttgggtttgggggtgggtccaggagacagaactctgggtgtctcaccatggcctggatccctctacttctccccctcctcactctctgcacaggctctgaggcctcctatgagctgacacagccaccctcggtgtctgtgtcctnaggacagacggccaggatcacctgctcgtggagatgctattcgaccaaagcaaatatgcttacgtcggtaccagcaagaacgccccggcacggcccctgtcttgtactttaatttaataaagtacgtttaggaagtaccggtcccctacgaccgggtacccctggacgtcgtattcctcgtcgctcgagctcgacgccgaacaaacgagtacctaacgttacaacctatcgtaggtcggacgtaccgaggacgaggacggacgaggtactacgtacttacttaccgttagtcgtacgttacagtaccgaagacgagacgtaggtcgtactaacttgtcgttacggttagtaccggggacgggtacggtaaaccaacgttaccgacccggttaacgtacggtaccgacgacccgaacggtcccgttcccggtcccccg

SEQ ID NO: 314749 - DNA, 705 bp, Homo sapiens
  misc_feature: GZ8MTXP02I6REE.52.33.C11.1.454.CMB.2.raw
  modified_base (197)..(197): a, c, t, g, unknown or other
  misc_feature (197)..(197): n is a, c, g, or t
  modified_base (264)..(264): a, c, t, g, unknown or other
  misc_feature (264)..(264): n is a, c, g, or t
  modified_base (303)..(303): a, c, t, g, unknown or other
  misc_feature (303)..(303): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggccgtccagtgtcaggtncagctggtggagtcggtgggggggctggtccaggcgtgggagtcctgagactctctgtgcagcctcnggattcaccttcagtacccatagaaatgcacgtggtccnccagctccgaggcgaaggggctgggacgtgggtgactacgttatactccctatgactaggaacacaaagtacgcaaacgtaccgacacggtacggtaccggtaggaaacggggccgttaagttcggaaaccacgtaccgttacccgaaggtaaacgaacgtaaacctacggaaaacgttaaacgttaacccgggtttacttaaccttaaaacgaaaacgttacgggaaaaccacgtaacccgttaggaaacgtaacggtcccgttaagggaaaaccggtaacgtaaccgggtactttaaacgtttacccgtttttaaacgtggtacggtaaccggaagggtaacgggaaaaccgttacggtaaacgttaaccgacgaacctaccggtacccgtaaaaaccgg

SEQ ID NO: 314750 - DNA, 615 bp, Homo sapiens
  misc_feature: GZ8MTXP02FJK6I.52.33.C11.1.454.CMB.2.raw
  modified_base (179)..(179): a, c, t, g, unknown or other
  misc_feature (179)..(179): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
  modified_base (449)..(449): a, c, t, g, unknown or other
  misc_feature (449)..(449): n is a, c, g, or t
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtntctgtgtcctcaggacagacggccaggatcacctgctcgtggagatgcaattgaccaaagcaaatatgacttactggtaccagcagaacgccccggcacggcccctgtctgtcttattanaaagtctttgagngcccngacggccctgagcattcncgtcgctcagctacagccgaacaaacncgtaccacgttcacctatccgagtggacgtccgaggcaaggnggacgaggctagacttaactagtagtcagtctaagtcgaaacganaggacctaagggtacggtactaacggtttaagttcgggttacgttaacgggtttaccggggacgggggaaaacccggtaaccgtaaaaaccgttccggaacccggtttaaccgtaacgggtaccaaccgggtaccccgtaaacggcccgtacccggttcccccccg

SEQ ID NO: 314751 - DNA, 729 bp, Homo sapiens
  misc_feature: GZ8MTXP02JQ4BP.52.33.C11.1.454.CMB.2.raw
  modified_base (651)..(651): a, c, t, g, unknown or other
  misc_feature (651)..(651): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagcttgggttttcctcgttgctcttttaagaggcgtccagtgtcaggtgcagctgggtggaggtcggtggggggggctgggtccgagggcgtggggacggtccctggacgtactctcctggtcgcacgccctcgtggtacttccgaccttcacgtaccccattagaaatcgactaccgtcgggtcccgcgacggcctccgaggacgaaggggcgtgggacggtgggtggactacgttatctaccctagtgtaagtacggaatacaaagtacgcctaacgtacgacgaaggtacggtccgtagggaacgggcccgtattacgacctatccgtacgaagacgaactaacgtacgtaaagtaaacggtttaccggtttacttaaccgtaaacgtaaaagttaccgggaaaaccgtaacgttaccggttaagggaacggtaaaccggtggttaacggaaacggggtaaccgtaaccgggttactttaacgtttaccgttttaacggnggtttaccggaaggtaacggaacgggtaacgtacgtaaaacgttccggaacgttccgaaccggtaccctaaaaccggg

SEQ ID NO: 314752 - DNA, 545 bp, Homo sapiens
  misc_feature: GZ8MTXP02HU25L.52.33.C11.1.454.CMB.2.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (273)..(275): a, c, t, g, unknown or other
  misc_feature (273)..(275): n is a, c, g, or t
  modified_base (278)..(279): a, c, t, g, unknown or other
  misc_feature (278)..(279): n is a, c, g, or t
  modified_base (282)..(283): a, c, t, g, unknown or other
  misc_feature (282)..(283): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (328)..(328): a, c, t, g, unknown or other
  misc_feature (328)..(328): n is a, c, g, or t
  modified_base (341)..(341): a, c, t, g, unknown or other
  misc_feature (341)..(341): n is a, c, g, or t
  modified_base (514)..(514): a, c, t, g, unknown or other
  misc_feature (514)..(514): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggganagcccaccctctcctgcgacggccagtcagngtgtgcactntagctgacaanaaactgcngcncngcncnnncannatnnancagcggcagngcactccagcagtcagtggcaggtgtctgacanacgtactcactcncactagtcgagtcgcctagactctagattgtttgactttatttatacgtctacgagctacgtacgtacgacctacgtcgtctccgttcggtttcgggacgggtacggtaaccggtaggtacgtaacggaacttaaaccgaaacgtacgttaggcggtactacgacaaccgttnttaccgttctccttactacctttaccctccg

SEQ ID NO: 314753 - DNA, 659 bp, Homo sapiens
  misc_feature: GZ8MTXP02F91NY.52.33.C11.1.454.CMB.2.raw
  modified_base (316)..(316): a, c, t, g, unknown or other
  misc_feature (316)..(316): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
  modified_base (465)..(465): a, c, t, g, unknown or other
  misc_feature (465)..(465): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggaggtcggtggggggggctgggtccgagggcgtggggacggtccctgagtctctcctgtgcagcctctggattccaccttcacgtacccatagaaatgccacgtcgggccncgaggcctcgaggacgaggggcgtgggagtggggtcgctacttagtactcccgtangagtaggaacganaaacgtacgcctaacgtacgacaggtacgtaccgggtagggaaacggggcccgtaagttaccggaactacgttcaccganacggaaccaacgtacgaaagtaacgtttaccggttacttaactaacgtaaacgtacgaacgtacgccgtagacgtacgagtacggagtaccgtacggtactttacgtttactttacggtagtacggtaaccggtaaggtaacggggtaacttacgtaaactttaaccgacgaccgtaccgtaacccgtaaacgg

SEQ ID NO: 314754 - DNA, 568 bp, Homo sapiens
  misc_feature: GZ8MTXP02IDD7A.52.33.C11.1.454.CMB.2.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (273)..(274): a, c, t, g, unknown or other
  misc_feature (273)..(274): n is a, c, g, or t
  modified_base (279)..(280): a, c, t, g, unknown or other
  misc_feature (279)..(280): n is a, c, g, or t
  modified_base (282)..(282): a, c, t, g, unknown or other
  misc_feature (282)..(282): n is a, c, g, or t
  modified_base (284)..(285): a, c, t, g, unknown or other
  misc_feature (284)..(285): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
  modified_base (421)..(421): a, c, t, g, unknown or other
  misc_feature (421)..(421): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggctcccagataccaccggagaagttgtattgacacagtctccagccaccctgtctttgtctccgagggggganacgcccaccctctcctgcagggccagtcagagtgtgcactntagctgacaacaacngcagcncngcncnntctanntncnncagacggcangcncncccagcngtcagtgctagtggtctgagacagctcactctcaccntcgagtcgcctcgacgcgtagtagttntttgactttaagtttactacgtgtacaagtccgaaaggtccggttaaccnccgtacgttcggcctttaccggttcggtttacgggggacgggtaacgggtaaccgtaaggggtcgaaacgtacgtaaccgaaacggtacgtggtcggcttacgacctaacgtagtcgttaccgtacttccgtaacttcccgttaccc

SEQ ID NO: 314755 - DNA, 643 bp, Homo sapiens
  misc_feature: GZ8MTXP02HH84I.52.33.C11.1.454.CMB.2.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (351)..(351): a, c, t, g, unknown or other
  misc_feature (351)..(351): n is a, c, g, or t
  modified_base (400)..(400): a, c, t, g, unknown or other
  misc_feature (400)..(400): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
tcagcgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccacctggtgtctgtgtcctcaggacagacggccaggatcactgctctgganatgctattnacctaaagcaaatactgcttaactggtaccagcaagaacgcccggccacggccctgtcttgactttatttataaagtctttaggagacggcccctacgacggtacccctggacgtcgatttcnccgtacggtcctcccagtctcgagaccggaacaacacgtacacggttanaccagtcagtcggatccgaggacgagacggacggtaggcgtacgaacttnttaaccgngttaccgaggttaccagtacgaacgaagacgaccgtaacggtggaacctacgtttaaagtccggttggttaaacggtttccggtaacggggaacggggtaaccctaaaaaccttcgggaaaacccgtcccgtaacggttccgaacggaccccgtttaaaacgggaccctttaccggtaccccccg

SEQ ID NO: 314756 - DNA, 632 bp, Homo sapiens
  misc_feature: GZ8MTXP02G71KD.52.33.C11.1.454.CMB.2.raw
  modified_base (205)..(205): a, c, t, g, unknown or other
  misc_feature (205)..(205): n is a, c, g, or t
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
tcagcgcagtacgacacgaccggtgctcgatttagagtgagctcgttgggtttgggggaggaactgctcagttaggacccagagggaaccatggaagccccagctcagcttctcttcctcctgctactctggcctcccagataccaccggagaagttgtattgacacagtctccagccaccctgtctttgtctccgagggggganacgcccaccctctcctgcgacgggccagtcagagtgttggctaacctcttacgcctacggtaacccaaacaaaaccgtggaccaggcctcccaggcctcctcatactagtgatcgcactccgacggacggccacgtgacactccccagccgtaggtcaggcggtcgaggtggtcgtggancagtctcactctccactanacgagcgtcgcgacgctaggtaatgtttgtacttaagtttactacgtgtacagctacgtcgtacgccctacgtgtcccttcgttcggtttccggggacgggtacggtaaaccggtagggttacgaacggtaacgtacgaaaaccggttaaacgtcgggttaccggaactcggaacctcgtaacttcccggtttacttaccgtttccttaccggtccctttaaccccgg

SEQ ID NO: 314757 - DNA, 607 bp, Homo sapiens
  misc_feature: GZ8MTXP02JGOD2.52.33.C11.1.454.CMB.2.raw
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
  modified_base (317)..(317): a, c, t, g, unknown or other
  misc_feature (317)..(317): n is a, c, g, or t
  modified_base (386)..(386): a, c, t, g, unknown or other
  misc_feature (386)..(386): n is a, c, g, or t
  modified_base (526)..(526): a, c, t, g, unknown or other
  misc_feature (526)..(526): n is a, c, g, or t
  modified_base (543)..(543): a, c, t, g, unknown or other
  misc_feature (543)..(543): n is a, c, g, or t
  modified_base (556)..(556): a, c, t, g, unknown or other
  misc_feature (556)..(556): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagcttgggttttcctcgttgctcttttaagaggcgtccagtgtcaggtgcagctggtggaggtcggtggggggggctggtccaggcgtgggacggtccctgagacctctcctgtncacgcctgnggtattccaccttcacgtacccatagaaatgctacgtgggtcccncgacggcctacgaggcgaaggggcgtgggtaggtgggtcgactacttagtactcccgtatgataggaanactaaagtacgacctaacgtaccgcgaaagtcggtaccggtaggaaacggggtcctaagttcgaacctatccgtacacgaacgactaacgtacgaaagttaaacgtacgttactactaacgaatagaacacgacgagagngacgtgagacgtacgtntagttctttacgngtacgacgaggtaacgtaaccgtagtacgtacgacgacaccgtaccgaacg

SEQ ID NO: 314758 - DNA, 582 bp, Homo sapiens
  misc_feature: GZ8MTXP02I8PME.52.33.C11.1.454.CMB.2.raw
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
  modified_base (374)..(374): a, c, t, g, unknown or other
  misc_feature (374)..(374): n is a, c, g, or t
  modified_base (479)..(479): a, c, t, g, unknown or other
  misc_feature (479)..(479): n is a, c, g, or t
  modified_base (529)..(529): a, c, t, g, unknown or other
  misc_feature (529)..(529): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagtcttggggttttcctcgttgctcttttaagaggcgtccagtgtcaggtgcagctgggtggagtcggtggggggggctggtccgaggctgggacggtccctgagtctctcctgtgcngctctggattcaccttcagtacccatgaaatgcacgtgggtccncgaggctacgaggcgaaggggctgggaggtgggtcggactacttatctcccgtatgagtggaanactaatacgctaactacgacaggaacgtccgtagggaaagggtccatcgaacattaccacgagagaaccaagtacgaaagacttacggttactactaacaaagtnaaacacgctagagacgacgtaggactaccgaggtacttagttactttagnggtacgaacgtaggaacgggtaacctcgaagttacacgtcgacgtccctaaag

SEQ ID NO: 314759 - DNA, 792 bp, Homo sapiens
  misc_feature: GZ8MTXP02H3ZXR.52.33.C11.1.454.CMB.2.raw
  modified_base (177)..(177): a, c, t, g, unknown or other
  misc_feature (177)..(177): n is a, c, g, or t
tcagcgcagtacgacacgaccggtgctcgatttagagtgagctcgttgggtttggggtctgagagacgagcccagcactggaagtcgccggtgtttccattcggtgatcatcactgaacacagaggactcaccatggagtttgggctgagctgggttttcctgttgctcttttaagnggcgtccagtgtcaggtgcagctgggtggaggtcggtggggggggctggtccgagggctgggacggtccctagacgtacctctccgtgtagcacgtcctctggacttctacctcacgtacccatagaaatcgcgtacgtcggtccgccgtaggccgtacccgaggtacggaaaggggtcgtaggggtaggttcggggtaggtcctaaacggtttactaccgtaccgttaagtacgtaaggtacggtaaacggaactaagtaaacgactaaccgttaccgacctaaggaacgggttccgtaacggggaacgggaccggttataccgaacctacgtacccgtaccgaaaggaaccgttaaacaacccgtaagtaaaaccgttaaaggtttacccggtttaatttaaccgaaactaaaaggttaaccaaaacccgaggtacccgttaggtaaaagggtacgtacggtaaacggtaacggtaaccggtaaacgtttacctttttaaacgtttaccggttttaaaccgtgggttaacgggtaaccggtaaaggggttaaaaccggttaaaccgttaacggttaaaccgttaccggaacgtacccggaaacccgtacccgg

SEQ ID NO: 314760 - DNA, 650 bp, Homo sapiens
  misc_feature: GZ8MTXP02JWGKR.52.33.C11.1.454.CMB.2.raw
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (367)..(367): a, c, t, g, unknown or other
  misc_feature (367)..(367): n is a, c, g, or t
tcagcgcagtacgacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggctgggaggtccctgagactctcctgtgcagcctctggattcacttcagtacccatgaaatgcacgtgggtccncaggctccgaggcgaaggggctgggagtggggnggactacgttatatcccctatgactaggaancaatagcaacgtacgcagagtcccgtaggaacgggccgattcgaccatcgtaccaagacgaaccaacgacgaaacgtaaacttaccggttaccttaacgtaactaaactacggaaacacggacccgttaggaacgagaccgttaggaaacgggtaccgaaccgggtacttactttaccgtttttaaacgtcggttacggtaccggtaaggtaaacgggggtaaaccccttaggtaaaaccgtttaacgaacggtacccgaaccggtacccccgttaaaacggg

SEQ ID NO: 314761 - DNA, 584 bp, Homo sapiens
  misc_feature: GZ8MTXP01B1U5P.52.35.D02.1.454.CMB.2.raw
  modified_base (240)..(240): a, c, t, g, unknown or other
  misc_feature (240)..(240): n is a, c, g, or t
  modified_base (357)..(357): a, c, t, g, unknown or other
  misc_feature (357)..(357): n is a, c, g, or t
tcagcgcagtacgacacgaccggtgctcgatttagcacacgatagttgggtttgggggtctcaggaggcagcgctctaaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtncttatgacttgtctctgtaccaacaccacctggacaaacgccccaaactcatcattttgagtcactaagcgcctcgagggtccctgatcgcttctctcggctgaagtctggacaacncggcctccctcgaccgtctctgggcctccgagctgaggatgaggcgtgtattactactcgctacctccgtactattagcgacggacgacgtaaccgtaaggtttacggggtttacggggttacgggtacgggaccggtaaacgggtacggttaccggtaccgttaccgtacgtacgaccgaacgccgtcgtccccgtccgtcgtaccttcgtccgttcccgtccccg

SEQ ID NO: 314762 - DNA, 525 bp, Homo sapiens
  misc_feature: GZ8MTXP01DJLLO.52.35.D02.1.454.CMB.2.raw
  modified_base (201)..(201): a, c, t, g, unknown or other
  misc_feature (201)..(201): n is a, c, g, or t
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccgaggggganagagccaccctctcctgcaggaccagtcagagtattagcaaacagttacttagcctggtaccagcagaatccnggccaggctcccgaggcctcctnatctatggtncgtcagcagggccagtggcatcccagaccaggttcagtggcaaggtgggtctgggacagacttcactcacacatcagcgagggtggagcgtggaggtatttgctagttgttatttagttgtcagctacgtagtggtagtctatagtactgtttcggcgaggggtaccaagtcgtggagttacgttacgaaacgtacgtgtggacttcgcgaacgtaag

SEQ ID NO: 314763 - DNA, 666 bp, Homo sapiens
  misc_feature: GZ8MTXP01BCAB6.52.35.D02.1.454.CMB.2.raw
  modified_base (243)..(243): a, c, t, g, unknown or other
  misc_feature (243)..(243): n is a, c, g, or t
  modified_base (420)..(420): a, c, t, g, unknown or other
  misc_feature (420)..(420): n is a, c, g, or t
tcagcgcagtacgacacgaccggtgctcgatttagcacacgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtncttatgactttgtctcctggtaccaacaccaccctggacaacgcccccaaactcatctattttgaggtcactaagccggccctcgacgggtccctgatcgcttctccgtggctcgaagtctagggacaacgacgggccctcccgtcgaccgtctcgtcgggcctccgaggctggagngtggagggtctaggtattactacgtcgacctaccgtacattacgtcggacgaacgggaccgtaacgtaaaccggttaagggttttcggggggttttaccggaccgggggtaaggggtaacccgtaaaggggttccggtaaaccccgttccgttaaccggtaccgaccggttccccgaacgggtcccgtacccggtccccccggttacgggttcccttacccgtttcccgttccggtttcccccccg

SEQ ID NO: 314764 - DNA, 641 bp, Homo sapiens
  misc_feature: GZ8MTXP01APECI.52.35.D02.1.454.CMB.2.raw
  modified_base (200)..(200): a, c, t, g, unknown or other
  misc_feature (200)..(200): n is a, c, g, or t
  modified_base (273)..(273): a, c, t, g, unknown or other
  misc_feature (273)..(273): n is a, c, g, or t
  modified_base (309)..(309): a, c, t, g, unknown or other
  misc_feature (309)..(309): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctccagatatcaccggagaaattgtgttgacgcagtctccaggcaccctgtctctgtcctccgagggganagacgccaccctctcctgcaggaccagtcagagtatagacaatagttactagcctggtaccagcagaatccgnggccaggcctcccgaggcctcctcatctagtggtcncgtccagcgacgggccacgtggactactcccgagaccctagggttcaggtggctaagggttcgggtcgtaggggaccaggtaccctttcgacttcctaccacctatacgagcgaggggtggacggtccgtaggtacggttagtttgacgttagttagttagtttagttcgtactacgtactacgttagttagggttaaggtctaacgtacgttacgtacggtttcggaccggaacggggtaaccaaggtacggtaagggttaacgttacgttaaaccggtaaaacggtacgttaaggtcgggtaccttacggaacccgttaaccgttaaccg

SEQ ID NO: 314765 - DNA, 573 bp, Homo sapiens
  misc_feature: GZ8MTXP01A3M8P.52.35.D02.1.454.CMB.2.raw
  modified_base (241)..(241): a, c, t, g, unknown or other
  misc_feature (241)..(241): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
tcagcgcagtacgacacgaccggtgctcgatttagcacacgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttgncttatgactttgtctctggtaccaacaccacctggacaaacgccccaaactcatctattttgagtcactaacgcgcctcgacgggtcctgactcgcttctctggctgaagtctggacaacgccggtccctccctgacccgtctcgtcgggcctcgaggtctagaggatggaggtctagacttactactgcctaccgtntaattcncgacgaagggaccaacgtaaacgttagggtttcgggggtttacgacggggtacggaaccgtaagggttcaccggttcgtacgcacgccacggtcctcgtcccctggccacttccgttccgtaacccc

SEQ ID NO: 314766 - DNA, 663 bp, Homo sapiens
  misc_feature: GZ8MTXP01BT15B.52.35.D02.1.454.CMB.2.raw
  modified_base (242)..(242): a, c, t, g, unknown or other
  misc_feature (242)..(242): n is a, c, g, or t
  modified_base (462)..(462): a, c, t, g, unknown or other
  misc_feature (462)..(462): n is a, c, g, or t
tcagcgcagtacgacacgaccggtgctcgatttagcacacgatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggactccagcagtgacgttgtntcttatgtactttgtctctgtaccaacaccacctgacaaacgccccaaatcatctattttgaggtcactaacgccggcctcgacggggtccctgactcgcttctcgtggctacgtagtcgtaggaccaacgaccggtccctccctcgtacccgtcgtcgtcgggcctcgaggtctaggagtagtacggagtctagtacttactactacgaccctaccgtntatacgtcgacgaacggacgtaaacgttaaccggttaagggttttcggggggttaaccggacggggtaacggggtaaaccgtaacgggttcggtacccggttaccgttaccggtccgaaccggttcccgttaacgggtcccgtccccggtcccccgtttcgggtacccttaccggttcccgtttcccggttaacccccccg

SEQ ID NO: 314767 - DNA, 534 bp, Homo sapiens
  misc_feature: GZ8MTXP01EVF0V.52.35.D02.1.454.CMB.2.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccgagggganagagccaccctctcctgcaggaccagtcagagtattagcaactagttactagcctggtaccagcagaatcctggccaggctcccgagcctcctnatctagtggtncgtcagcgagggccagtggcactcccagacccaggttcaggtcggcaaggtgggtctgggacagacttcactctacacatcagcgagggtgacgccgtaggtagtatttgacgtagtgttattattgtacagactagtagtggtaggtctactagtactaagtttcggacgttaggggaccaggcgtaggagacttacaaacgtacgtggtggcttacgcgaacctaag

SEQ ID NO: 314768 - DNA, 597 bp, Homo sapiens
  misc_feature: GZ8MTXP01EWV8T.52.35.D02.1.454.CMB.2.raw
tcagcgcagtacgacacgaccggtgctcgatttagcacacgatagttgggtttgggggggtctcaggaggcagcgctctaaggacgtcaccaccatggcctgggctctgctcctcctcaccctcctcactcagggcacagggtcctgggcccagtctgccctgactcagcctccctccgcgtccggtctcctggacagtcagtcaccatctcctgcactggatccagcagtgacgttggtgcttatgtactttgtctctgtaccaacaccacctgacaaacgccccaaactcatctattttgagtcactaacgcgccctcacgggtccctgatcgcttctctcgctcgaagtctcggaacacgcgccctccctcgacctctcgtcgggtcctccgaggctaggaggtatggaggcttagactttacacgtcactaccttacgattagcgacgaggacctaacgttaaggttacggtttcgggggttacggacgggacggtaacgtaacggtcgaccgtaccgttacgccgacggacccgacggttcccgtcccgtccccgttcggtccctaccgttccgttcccgttccccgccccg

SEQ ID NO: 314769 - DNA, 674 bp, Homo sapiens
  misc_feature: GZ8MTXP01DLIPF.52.35.D02.1.454.CMB.2.raw
  modified_base (245)..(245): a, c, t, g, unknown or other
  misc_feature (245)..(245): n is a, c, g, or t
tcagcgcagtacgacacgaccggtgctcgatttagcacacgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctctgcactggactccagcagtgacgttgggtntcttatgttactttcgtcctccgtacgtaacccaaccacccaccgtacgaaccaaaccgaccccctaaactctacttacttagtttacgacgtactaacgtacgccgtcctacgacggtcctgctcgtcttctccgtcgtcgtacgtacgtcgtaacgacaaccgaccgtccctcccgtacgtacccgttcgtacggtcggtccgtaccgacggtacgtaggaaggtagtacggtacggtcttacgtaacttacgtacgtacgacctaccgtactactacgtacgtacgacggtaacgtaacgtaaacggttaacgggtttacggggttacgggtacgggtacgggtaacggtaacggttacgtaccgttaccgtacgtacgacgaccgacgtcgtccgtcccgtccgtcgttcctccgttccgtcccg

SEQ ID NO: 314770 - DNA, 700 bp, Homo sapiens
  misc_feature: GZ8MTXP01AF5R3.52.35.D02.1.454.CMB.2.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccgagggganagacgcccaccctntcctgcacggaccagtcagtagtattagacaactagttactagcctggtaccagcagaactccgtggccaggcctccccgaggtcctaccttcaagttcctaagtcgggtacgtccgtaccgaggccgaacgggggtccccaagttcggccaaacgtccccgaaggtaccccgtagggttcaaggttcggacctaaggggttcgggtccgtaggggaactacggtaccctttcaacctttccacccgacctacgtaccgacggaccggtaggggttacggacggtccgttagggtaacggttaagtttcgacgttaggttaggttaacgtttaagtcgttacgaacggtacctaacgttagttacgggttaacgtcgtaacgtacggttaaccgttacggtttaacgggaccggttacggggaccttaaggacgtaggacgttacgttacgaaaccgtagtgtcggacttcgaaccaacgttaacg

SEQ ID NO: 314771 - DNA, 609 bp, Homo sapiens
  misc_feature: GZ8MTXP01EH4ZM.52.35.D02.1.454.CMB.2.raw
  modified_base (188)..(188): a, c, t, g, unknown or other
  misc_feature (188)..(188): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (442)..(442): a, c, t, g, unknown or other
  misc_feature (442)..(442): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (488)..(488): a, c, t, g, unknown or other
  misc_feature (488)..(488): n is a, c, g, or t
  modified_base (560)..(560): a, c, t, g, unknown or other
  misc_feature (560)..(560): n is a, c, g, or t
tcagcgcagtacgacacgaccggtgctcgatttagcacacgatagttgggtttgggggggggtctcaggaggcagcgctctcaggacgtcaccaccatggcctgggctctgctcctcctcaccctcctcactcagggcacagggtcctgggccccagtctgccctgactcagccctcctcccccccgngtccgggtctcctggacagtcagtcaccatcctcctgcactgatccagcagtgacgttgncttatntcttntctctaggtaccacgaccaccgtgaccaaacgcccccaaatcattcttattttgagtcaacgtaacgccgtcccgtcgacgggtccctagtactcgcttactccgtcggctacgtactcgtaaccggacaaccggcccggtaccctcccgtcgtacccgttcgtcgtcgggacctcgagtcgngaggatggagtctanattaccncacgacctactgtaatcacgacgnggtactaacgtaaaggtttacgggttgggggttacgacgggacggtaacgacgggttcgaaccgttccgtanacgccgccgacggtcctcccgccctgccttaccgtccgttcctaacccc

SEQ ID NO: 314772 - DNA, 678 bp, Homo sapiens
  misc_feature: GZ8MTXP01A4UA6.52.35.D02.1.454.CMB.2.raw
  modified_base (241)..(241): a, c, t, g, unknown or other
  misc_feature (241)..(241): n is a, c, g, or t
tcagcgcagtacgacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctctgcactggactccagcagtgtacgttggtntcttatgtactttgtctccgtggtaaccaacaccacctcggactaaaccgccccaaactcatctattttgagtacacgtagccgtcctgacgggtcctgactcgtcttccgtcgtcggctacggtaacgttcgtaacgggaccctaacggccgggtccccttacccgtcgtacccgtcttcggtcgggtcctacccgagggtctagggacggtagttagggacgtctacggtaacttactaacgtcgtaccacgtactagtatcgaacgacggactaaacgtaacggtttagggtttcgggggttaccggacgggtaaagggtaaccgtaagggttaccggtaacccgttcgtaaccggtacgaaaccggcccgttaaacggggtccctaccgggtccccctgggtacccttacctttccggttcccgttcccccgg

SEQ ID NO: 314773 - DNA, 782 bp, Homo sapiens
  misc_feature: GZ8MTXP01AN67P.52.35.D02.1.454.CMB.2.raw
  modified_base (245)..(245): a, c, t, g, unknown or other
  misc_feature (245)..(245): n is a, c, g, or t
tcagcgcagtacgacacgaccggtgctcgatttagcacacgatagttgggtttggggggggtctcaggaggcagcgctctaaggacgtcaccaccatggcctgggctctgctcctcctcaccctcctcactcagggcacagggtcctgggcccagtctgccctgactcacgcctccctccgcgtccggtctcctggacagtcagtcaccatctcctgcactggactccagctagtgtacgttgtncttatgtacttgtcctccgtcgtaacccaaccacccaccgtagaccaaaccgacccccaaatcattacttagtttcggacgtaccaacgtaacgccggtaccctggacgggtccctagtctcgtcttctcgtacggtacctacgaacgttctacggaaacccaaccgcccggtccctaccctaggtcccgttcgtcgtcgggccctaccggtagtccgtaggacgggtaatcggtaacgggtacctaggttaaactttaccgacttcggaaccttaccctaggggtaaacttagaccggacgtaaaccggggactaaaacccggtttaacggttaaaggggggttttttccgggggttaacccggggtaagggaaaccgggggtacccgttaaacgggggtcccttaaccggggtaacccttaaacggggtcctaaaccccgggaccgggttaacggttccccgtttaacccggggccccccgttcgggttaaacccctcccgtttaccccgttaaccccgttaacccccgtaaccg

SEQ ID NO: 314774 - DNA, 523 bp, Homo sapiens
  misc_feature: GZ8MTXP02GSHZK.52.35.D02.1.454.CMB.2.raw
  modified_base (241)..(241): a, c, t, g, unknown or other
  misc_feature (241)..(241): n is a, c, g, or t
  modified_base (511)..(511): a, c, t, g, unknown or other
  misc_feature (511)..(511): n is a, c, g, or t
tcagcgcagtacgacacgaccggtgctcgatttagcacacgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtnattatgactttgtctctggtaccaacaccaccctgcaaagccccaaactcatcattttgagtcactaagcggccctcagggtccctgatcgcttctcctggctcgaagtctggcacacggcctccctgaccgtctctgggctccaggctgaggatgaggctgattacactgcactcatatgacacggacaacaaagttaaggtttcggggtttcgacgggacggaccgaaggtcgaccgtctacgcacgcgaagctccgccctcggtacnctctcttacccc

SEQ ID NO: 314775 - DNA, 589 bp, Homo sapiens
  misc_feature: GZ8MTXP02HWD4S.52.35.D02.1.454.CMB.2.raw
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (357)..(357): a, c, t, g, unknown or other
  misc_feature (357)..(357): n is a, c, g, or t
tcagcgcagtacgacacgaccggtgctcgatttagcacacgatagttgggtttggggggtctcaggaggcagcgctctaaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggncttangactttgtctctggtaccaacaccacctggacaagccccaaatcatcattttgagtcactaagcggcctcgaggggtccctgatcgcttctctcggctcgagtctggcaacncggcctccctgacccgtctcgtgggccctcgaggtctgaggagtgtacggcgtagtacttacgtacgtacgtactacctactactatacgacgacgacgacgtaacgttaacggtttacggggtttacgggtacgggtacgggtaacggtaacggtacggtaccgtaccgtacgtacgaccgaccgacgccgtccgtcccgtccgtcgtaccgtccgtccgttcccgtcccg

SEQ ID NO: 314776 - DNA, 519 bp, Homo sapiens
  misc_feature: GZ8MTXP02JV95F.52.35.D02.1.454.CMB.2.raw
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (350)..(350): a, c, t, g, unknown or other
  misc_feature (350)..(350): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccaggggagagagccaccctctcctgcaggaccagtcagagtattagcaacagttacttagcctggtaccagcagatcctggccaggctcccaggctcctnatctatggtncgtccagcagggccatggcatcccagaccaggtcagtggcagtgggtcnggggacagacttcactctcacatcagcagggtgagccgtgaggtatttgcgtagtgttattagttgtcaggtacactagtggtaggtcacgtagtactacgtttcggaccgtaggggaccgaagcgtaggacgtactacgaaacgactaggtcggctcggaccactacg

SEQ ID NO: 314777 - DNA, 531 bp, Homo sapiens
  misc_feature: GZ8MTXP02GJ0LR.52.35.D02.1.454.CMB.2.raw
tcagcgcagtacgacacgaccggtgctcgatttagcacacgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaacgcccccaaactcatcattttgaggtcactaagcgccctcgaggggtccctgatcgcttctcctgctcgaagtctggcacgacggcctccctgaccgtctctcgggctccgaggctgaggatgaggctgattacactgcacctcatatgcaaggcaacaataagtttgggggtttacggcgggagggaccaaggtcgaacccgtctaacgtcacgcccaaggctcgcccctcggcactctcgttccccc

SEQ ID NO: 314778 - DNA, 532 bp, Homo sapiens
  misc_feature: GZ8MTXP02HB1PB.52.35.D02.1.454.CMB.2.raw
  modified_base (434)..(434): a, c, t, g, unknown or other
  misc_feature (434)..(434): n is a, c, g, or t
tcagcgcagtacgacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggatccagcagtgacgttggtgcttatgactttgtctcctggtaccaacaccaccctggcaaacgcccccaaactcatcattttgaggttcactaagcggccctcgaggggtccctgatcgcttctcctggctcgaagtctggcacacggcctccctgaccgtctcgtcgggctccaggctgacggatgaggctgattacactgcacctcatatggnacggcacaacgaagtttgggggtttcgacggtagggaccaagggtgaccgtcgtacgtcacgcccaaggctcgccccgtcggtccactctcgttcccc

SEQ ID NO: 314779 - DNA, 648 bp, Homo sapiens
  misc_feature: GZ8MTXP02FR68H.52.35.D02.1.454.CMB.2.raw
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccgaggggagagacgcccaccctctcctgcaggaccagtcagagtattagacaactagttactagcctaggtaccagcagactccgtggccacggtcctcccgaggtcctcctctatctagtcggtcgccgtccaggcgacgggccaggtcgactactaccccgagtacccgtaggttcaggtcggcgtagggttcgggtcgtgggaactacgtacctcctactccaccacctagtacgagacggagggtcgacgtccgtaggtagttagttagacgttagggttattagttaggttcgtacgtacgtacgtaacggttagtacgggtacggtactaacggttaacgttacgttacggtttacgggacgggtaacgggaacgtacggtacggtaggtaaacgtacgtaaaccgtaaaaccggtacgtagtacgggtacctacggacctacgtttaccg

SEQ ID NO: 314780 - DNA, 581 bp, Homo sapiens
  misc_feature: GZ8MTXP02GYMHW.52.35.D02.1.454.CMB.2.raw
  modified_base (247)..(247): a, c, t, g, unknown or other
  misc_feature (247)..(247): n is a, c, g, or t
tcagcgcagtacgacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttangtactttgtctcctggtaccaacaccaccctggcaaacgcccccaaactcatcattttgagtcactaagcgcctcgacgggtcctgactcgcttctcctgctcgagtctggcacgacggcctcccgtcgacccgtctcgtcgggcctccgaggctggaggatgacggctagtattactacttcgctaacctcatatcgacacggacgaactaaacgtaaggtttcgggggtttacggacgggtaacgggtaaccgtagggtacgacccggttcctacggtaccacgcccgaaggccgtccggcccccgtcggtccacttccgtccgttcccccg

SEQ ID NO: 314781 - DNA, 542 bp, Homo sapiens
  misc_feature: GZ8MTXP02HY3IV.52.35.D02.1.454.CMB.2.raw
  modified_base (188)..(188): a, c, t, g, unknown or other
  misc_feature (188)..(188): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
tcagcgcagtacgacacgaccggtgctcgatttagcacacgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtntcctggacagtcagtcaccatctcctgcatggatccagcagtgacgttggtncttangtactttgtctcctggtaccaacaccaccctgcaaacgcccccaaactcatcatttttgaggtcactaagcgcctnacgggtccngactcgctctctgctcgagtctggcacgacggcctaccctgacccgtctcgtcgggcctccgaggcctggacggatgaggctgattacactgcactcatatgaccaggacgacaaacgtaaggtttggggtttacggacggtaggacccgaaggtcgaccgtctacgtcgacgccgaaggcctcgccccgtggaccacctcgtcgttccccc

SEQ ID NO: 314782 - DNA, 687 bp, Homo sapiens
  misc_feature: GZ8MTXP02HCJZH.52.35.D02.1.454.CMB.2.raw
  modified_base (200)..(200): a, c, t, g, unknown or other
  misc_feature (200)..(200): n is a, c, g, or t
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccgagggganagagcccaccctctcctgcaggaccagtcagagtaattagcaactagttactagcctggtaccagcagatccnggcagctccagctccnatctatgncgtcagcgacgggccacgtggaccactccccgagacccctaggttccaggtcggaccgtagggtcggggtccgtgggggaacctacggtacctttccaaccttctacccaacccgtactaccgaacggccggtaagggggttcgggaacggtcccgttagggtaacgggtttagtttacggtacgttaaggtttagtttaaagtttagttttcggttacctaacggttaccttaacgttaacggtttagggttaacgggttacctaaaccgttaacgttaaccgttaacggtttttacgggacccggttaaacggggaaacccgtaaacggtcggtacggaacgtaacgtaacgaaaacgtacgtaggtacggcgtacgacctacgtacg

SEQ ID NO: 314783 - DNA, 552 bp, Homo sapiens
  misc_feature: GZ8MTXP02F4EHF.52.35.D02.1.454.CMB.2.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccgagggganagagccaccctctcctgcaggaccagtcagagtattagcaacagttactagcctggtaccagcagaatctggccaggctccaggctcctnatctatggtnccgtcagcagggccagtggcatcccagacccaggttcaggtcggcaggtgggtctgggacagtacttcatcncacntcagcagggtgacgctaggagtatttgacgtagttgtatttagtgtactagctaacgtagtcggttaggtactacgtaagttaacgttacgtttacggaccggtaaagggaccctaaaggtcgtacggaaagacttaacgaaacgtaaacgtggtacggactacggacaaccgtac

SEQ ID NO: 314784 - DNA, 567 bp, Homo sapiens
  misc_feature: GZ8MTXP02HM99V.52.35.D02.1.454.CMB.2.raw
  modified_base (293)..(293): a, c, t, g, unknown or other
  misc_feature (293)..(293): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccaggggagagagccaccctctcctgcaggaccagtcagagtattagcaactagttacttagcctggtaccagcagatctggccaggctcccaggcctccctnatctatggtgcgtccagcagggccagtggcatcccagacctaggttcaggtggctagggtgggtcgtggggactaggtaccttcgactctaccaccatcagcgagggtggagccgtagacggtagtttgacgtagttaggttatttagtttgtacaggtcctaagtagttggtagtcgacgtagtaacgtacgttttcgggaccgtaggggaccgaaaggtcgtacggagtaacgtaacgaaaacgtacgtaggtcggctcggacctacgtacg

SEQ ID NO: 314785 - DNA, 642 bp, Homo sapiens
  misc_feature: GZ8MTXP02G7YJS.52.35.D02.1.454.CMB.2.raw
  modified_base (200)..(200): a, c, t, g, unknown or other
  misc_feature (200)..(200): n is a, c, g, or t
  modified_base (242)..(242): a, c, t, g, unknown or other
  misc_feature (242)..(242): n is a, c, g, or t
  modified_base (270)..(270): a, c, t, g, unknown or other
  misc_feature (270)..(270): n is a, c, g, or t
  modified_base (292)..(292): a, c, t, g, unknown or other
  misc_feature (292)..(292): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccgagggganagagccaccctctcctgcaggaccagtcagagtattagcaangttactagcctggtaccagcagaatccnggccaggctcccaggcctcctnatctatggcgctcagcgacgggccatggcactcccagacctggttcaggtggctaggttgggtcctaggggactaggtacctttcgacttccgtacacccgtatcgagcgtagggtcggacgtccgtaggtaggtaagtttcgacgtaggttagtttagtttagttgtacgtaggtacctaacgttaggttagggttaacggttacgtaaccgtaaagttaacgttaaccggtttttacgggacccgggtaacgggggtaaacccgtaaacgggtaccgttacgggaacgtaacgttaaccgaaaacggtaaaccgttaggtacgggtcgttacggaccgtaccctaacg

SEQ ID NO: 314786 - DNA, 598 bp, Homo sapiens
  misc_feature: GZ8MTXP02JSWA2.52.35.D02.1.454.CMB.2.raw
  modified_base (243)..(243): a, c, t, g, unknown or other
  misc_feature (243)..(243): n is a, c, g, or t
  modified_base (352)..(352): a, c, t, g, unknown or other
  misc_feature (352)..(352): n is a, c, g, or t
tcagcgcagtacgacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggactccagcagtgacgttggtncttatgtactttgtctcctggtaccaacaccaccctggacaaacgcccccaaactcatctattttgaggtcactaacgccggtccctcgacgggtcctgactcgcttcncctggctcgaagtctggcacgccgcctccctgaccgtctcgtcgggcctccgaggcgtaggacggtatcggagggctagtacttacgtactcgccctactctatactcgcgacgacgtaactaaacgtaaggttttcgggggttacgggacggtaaggggtacccgtaaggtccgaccgtaccgtacgtacgacgacccgaacggtccgtccggtccccgtcggtcaccttccgtacctttccccc

SEQ ID NO: 314787 - DNA, 566 bp, Homo sapiens
  misc_feature: GZ8MTXP02ILZHI.52.35.D02.1.454.CMB.2.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (399)..(399): a, c, t, g, unknown or other
  misc_feature (399)..(399): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccgagggganagacgccaccctctcctgcaggaccagtcagagtatagcaactagttactagcctaggtaccagcagaatcctggccaggcctcccgaggcctcctnatctatggtncgtcagcgagggccacgtggcactcccgagaccctaggttcaggtcggctaggttcgggtcgtgggactagtaccttcgactctaccactancgagcgagggtgacgcgtgagtatttgctagttgttaattagttgtctagtactacgtagtggtacgtacgacgtagtacttacgtttacggaccggtacgggaaccgtaaggtacgtacgggaactacgtacgaaaacgtacgtacgtacggacgtcgacactacg

SEQ ID NO: 314788 - DNA, 593 bp, Homo sapiens
  misc_feature: GZ8MTXP02I0YXH.52.35.D02.1.454.CMB.2.raw
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (435)..(435): a, c, t, g, unknown or other
  misc_feature (435)..(435): n is a, c, g, or t
tcagcgcagtacgacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatcctcctgcactggatccagcagtgacgttggtgcttatgtactttgtctctgtaccaacaccacctgacaaccgaccccaactcatctattttgagtcactacgcgcctcgacgggtcctgactcgcttctctgctcgagtcgtcgcacgccgtcctccgtcgaccgtctcgtcgggctcgngcgngaggntgagtntagtatactactcgacctactctattagngacgacggactaacgtaaacggttacgggttttcgggggttacgggacgggggtaacggtaacgtaacgggtcggtaacccgttacgttacgaccgaaccggccgaacggtccgttcccggacccgttcggacctcccgttcgttcccggtttccccg

SEQ ID NO: 314789 - DNA, 658 bp, Homo sapiens
  misc_feature: GZ8MTXP02HZAB2.52.35.D02.1.454.CMB.2.raw
  modified_base (243)..(243): a, c, t, g, unknown or other
  misc_feature (243)..(243): n is a, c, g, or t
  modified_base (473)..(473): a, c, t, g, unknown or other
  misc_feature (473)..(473): n is a, c, g, or t
tcagcgcagtacgacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtcgacgttggtntcttatgtactttgtctcctcggtaccaacaccacctcggaccaaacgacccccaaactcatctatttttgagtcactaagccggccctcgacggggtcctgactcgcttctccgtcgctcgacgttcgtcggacaccgccgcctccctcgaccgtctcgtcgggcctccgaggtcgtaggacggtagtggacgtcgtagtacgttacttacgcgtccacctctaagtancggacacggaccgtaacgtaacgttaacgggtttcgggggtttaccggacggggaacgggtaacccggtaacgggttaccggtaacccgttacccggtaaccggtaccgaacccggtacccgaaacggtccgttacccgcccccgttacgggtaccctaccggttccctttaacccggttccccc

SEQ ID NO: 314790 - DNA, 531 bp, Homo sapiens
  misc_feature: GZ8MTXP02F8N9A.52.35.D02.1.454.CMB.2.raw
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (357)..(357): a, c, t, g, unknown or other
  misc_feature (357)..(357): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccaggggagagagccaccctntcctgcaggaccagtcagagtattagcaacngttacttagcctggtaccagcagaatcctggccaggctcccgaggcctcctnatctatggtncgtccagcagggccacgtggcatcccagaccaggttcagtggcaggtgggtcnggggacaggaccttcactcacacatcagcgagggtgagcgtgagtattgcgtagtntattagttgnagacactagtggtacggtcacgtagtactacgtttacggccgtaggggaccaaggacgtacggaagacgtacgaaaacgtacgtaggtacggactacggaccacgtac

SEQ ID NO: 314791 - DNA, 563 bp, Homo sapiens
  misc_feature: GZ8MTXP02GDQI4.52.35.D02.1.454.CMB.2.raw
  modified_base (240)..(240): a, c, t, g, unknown or other
  misc_feature (240)..(240): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
tcagcgcagtacgacacgaccggtgctcgatttagcacacgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggngcttatgactttgtctcctggtaccaacaccaccctggcaaacgcccccaaactcatcattttgagtcactaagcggccctcaggggtccctgatcgcttctcctggctcgaagtctggcacacggcctccctgaccgtctctgggcctcaggctgaggatgagctgattacactgcacctnatangacagacgaactaaacgttaaggtttgggggttacggacgggtaacggtaacgtaaggtcgtaccgtaccgtacgtacgacgacccgaaggtccgtcccgtccccgttcggtacctaccgttccttaccgttacccc

SEQ ID NO: 314792 - DNA, 531 bp, Homo sapiens
  misc_feature: GZ8MTXP02GKC3Q.52.35.D02.1.454.CMB.2.raw
  modified_base (361)..(361): a, c, t, g, unknown or other
  misc_feature (361)..(361): n is a, c, g, or t
  modified_base (411)..(411): a, c, t, g, unknown or other
  misc_feature (411)..(411): n is a, c, g, or t
tcagcgcagtacgacacgaccggtgctcgatttagcacacgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctctggtaccaacaccaccctggacaaacgcccccaaactcatcattttgagtcactaagcggcctcgagggtccctgatcgcttctcctgctcgaagtctggcacncggcctccctgacctctctgggctccgagctgacgatgaggctgtatacnctagcactcatatgcagcacaagtaagtttgggggttacgcggtaggaccaaggtgaacccgtctaacgtcgacgcccgaaggtcgtccgcccccgtggcctacttccgtctttaccccc

SEQ ID NO: 314793 - DNA, 632 bp, Homo sapiens
  misc_feature: GZ8MTXP02G2BI3.52.35.D02.1.454.CMB.2.raw
  modified_base (229)..(229): a, c, t, g, unknown or other
  misc_feature (229)..(229): n is a, c, g, or t
  modified_base (277)..(277): a, c, t, g, unknown or other
  misc_feature (277)..(277): n is a, c, g, or t
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
  modified_base (411)..(411): a, c, t, g, unknown or other
  misc_feature (411)..(411): n is a, c, g, or t
tcagcgcagtacgacacgaccggtgctcgatttagcacacgataggttggggtttggggagagctgctcagttaggacccagagggaaccatggaaaccccagcgcagcttctcttcctcctgctactctggctcccagatatcaccggagaaattgtgttgacgcagtctccaggcaccctgtctctgtctccgaggggagagacgcccacctctccgtgcaggaccngtcagacgtatagcaactagttactagcctggtaccagcaagactcgnggccaggtctccgagcctcctanatcgtagtggcnccgtcaaggcgacgggcctagtcggactacgtacccgagaccctaggtcaggtcggactaggggtcggtcgtacgggactaacggttccttcaccgttnaccgacctagtaccgacgacggtagggacgtacgccggtaggtaggttaacgtttcgagttaaggttgttaaacgtttgttaggtctaacgggtacctaagtaagttcgggtacggtacacgttacgtacgttacgtttacgggaccgtaacgggaccgtaagtaccggtagtaacgcgtaaaacggaacgtaacggtcggtaggactacgaacgtctacg

SEQ ID NO: 314794 - DNA, 526 bp, Homo sapiens
  misc_feature: GZ8MTXP02FPEJ2.52.35.D02.1.454.CMB.2.raw
  modified_base (199)..(199): a, c, t, g, unknown or other
  misc_feature (199)..(199): n is a, c, g, or t
  modified_base (242)..(242): a, c, t, g, unknown or other
  misc_feature (242)..(242): n is a, c, g, or t
  modified_base (302)..(302): a, c, t, g, unknown or other
  misc_feature (302)..(302): n is a, c, g, or t
  modified_base (415)..(415): a, c, t, g, unknown or other
  misc_feature (415)..(415): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccagggganagagccaccctctcctgcaggaccagtcagagtattagcaacngttactagcctggtaccagcagaatcctggccaggctcccaggcctcctcatctatggtncgtcagcagggccagtggacatccccagacccaggttccagtggcaggtgggtctgggacagacttcactctacacatcacgcgagggtgagccgtgaggtatttgctagttntattattgtcagtctacgtagtggtagtcacgtagtactaacgtttcggacgacgggacaaggtcgtacggaagacgtacgaaacgtaacgtgtacggctacgacactacg

SEQ ID NO: 314795 - DNA, 656 bp, Homo sapiens
  misc_feature: GZ8MTXP02IKUIB.52.35.D02.1.454.CMB.2.raw
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (330)..(330): a, c, t, g, unknown or other
  misc_feature (330)..(330): n is a, c, g, or t
tcagcgcagtacgacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggatccagcagtgacgttggncttangtactttgtctcctggtaccaacaccacctggacaaacgcccccaactcatctattttgagtcactagccgcctcgacgggtccngactcgtcttctcctgctcgatctgacacgcgtcctacctcgaccgtctcgtcggcctcgaggtctaggagagtggaggtctagtaacttactacgtacgcctaacctactattacgtcggaaccgacgggaaccgtaaacgtaaacggttaaacggggtttttcggggggtttaccgggaacgggggtaacggggtaaccgttaaaacggggtccggtaaccccggttaccgtaccggttaccgaaccggtaccccgaaacggtcccgttcccgacccccggtttcgggtaccctacccgtttccgttcccggtttaaccccccg

SEQ ID NO: 314796 - DNA, 605 bp, Homo sapiens
  misc_feature: GZ8MTXP02H8RFV.52.35.D02.1.454.CMB.2.raw
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
tcagcgcagtacgacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgcctgactcagcctccctcgcgtccggtctcctggacagtcagtcacatctcctgcactggactccagcagtgacgttggtncttangtacttgtctcctgtaccaacaccacctggaccaaacgccccaaatcatctattttgagtcactagcgcctgacgggtcctgactcgtcttctccgtgactcgaagttcgtacggcaaccgtccggtcctcccgtgtaccgtctcgtcgggcctccgagtcgtcgagcgtaggacgcttagactttactaacgtcgtacctacctatagtacgtcgacacggacaacgtaaacgttaacgggttttcgggggttacggacgggtaacgggtaccgtaagggtcgaccgttaccgtacgtaccgacgtaccgtacggcccttaccgaccccgttcggtcctaccgtcgtttccgtacccccg

SEQ ID NO: 314797 - DNA, 612 bp, Homo sapiens
  misc_feature: GZ8MTXP02I63DS.52.35.D02.1.454.CMB.2.raw
  modified_base (240)..(240): a, c, t, g, unknown or other
  misc_feature (240)..(240): n is a, c, g, or t
tcagcgcagtacgacacgaccggtgctcgatttagcacacgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggngcttatgtactttgtctcctggtaccaacaccaccctggaccaaacgcccccaaactcatctatttttgacggtcaactaagcggccctcgacggggtccctgactcgtcttctcctgctcgagtctgcacgcgcctcctgacctctcgtcgggctccgaggctagaggactgaggctgtatactactgacactcatactgcaggacaacgtaacgtaaggtttcgggggtttacggacgggaacggggtaccgtaaaagggtccgtacccggttaccgtaaacggttccgaacggaccccgtaaacgggccgttaaccggtaccccccgttcggtaccgtaaccctttcgttaccccggttttaacccccc

SEQ ID NO: 314798 - DNA, 737 bp, Homo sapiens
  misc_feature: GZ8MTXP02FMTT4.52.35.D02.1.454.CMB.2.raw
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
tcagcgcagtacgacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggntcttatgactttgtctcctgtaccaacnccacctgaccaaacgcccccaatcatctattttgagtacactaacgcgccctcgacgggtcctgactcgtcttctccgtgcctacgaacgtctacggacaccgaccggtccctcccgtcgtaccgtcgtcgtcgggacctccgacggtcgtaggaggtacgtaggacggtactacggtacttaacgtaccgtacgtaccctaaccttaccgtagtacgtacggaccgaaccgggtaccgtaaaaccgttaaacgggtttaacgggggtttttaccggggggtttaccgggggtaaccgggggaaaccggggtaaccggttaaaacgggggttacccggtaaacccccggttacccggttaaaccggttacccgaacccggtacccggaaaacggttccccggtaccccggtccccccgttaccggggttaaccctaccggtttcccgtttaccccgtttcccccccgg

SEQ ID NO: 314799 - DNA, 603 bp, Homo sapiens
  misc_feature: GZ8MTXP02H0B3X.52.35.D02.1.454.CMB.2.raw
  modified_base (187)..(187): a, c, t, g, unknown or other
  misc_feature (187)..(187): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (437)..(437): a, c, t, g, unknown or other
  misc_feature (437)..(437): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
tcagcgcagtacgacacgaccggtgctcgatttagcacacgatagttgggtttggggggtctcaggaggcagcgctctcaggacgtcaccaccatggcctgggctctgctcctcctcaccctcctcactcagggcacagggtcctgggcccagtctgccctgactcagcctcctccgcgtccgggtntcctggacagtcagtcaccatctcctgcactggactccagcagtgacgttggngtcttancgtactttntctctgtaccaacaccacctcgacaacgaccccaaatccatctattttgacgtacactaacgccgcctcgacggtcctgactcgtctctcccgtgtctcgaagtctcggacacgtaccggcctacccgcgtaccgttcgcgtcggcctccgagcgtgaggactgagtctaggacttctacncgtactacctntacgttacncgacgagtacgaacgtaacggttacgggtttcggggttacggacgggtaacggtacgtaacggtaccgtaccgtaaccgtacgtaccgacggacccgtaacgccgttacccgtcccgtcgtaccgtaccgttccgttccgtccccg

SEQ ID NO: 314800 - DNA, 541 bp, Homo sapiens
  misc_feature: GZ8MTXP02JJ7J2.52.35.D02.1.454.CMB.2.raw
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggccaccctgtctctgtctccgaggggagagacgccacccgtctcctgccagggacccagtcagagtattagcaacagttactagcctggtaccngcagatcngcaggctccaggctcctnatctagtggtncgtcagcagggccagtggcatccccgagaccctggttcagtggcaggtggtctgggacngacttcacttcacaccatcagcgagggtgagtccgngagtatttgctagtgttattagttgtcagtcagtacgtggtagtcacgtagtactacgtttcggacgtacggggtaaccaaggtcgtagggaacgtacgttaacgaaaacgaacttcggaggtcgtacggacctaccgtacg

SEQ ID NO: 314801 - DNA, 630 bp, Homo sapiens
  misc_feature: GZ8MTXP02GGZIA.52.35.D02.1.454.CMB.2.raw
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
tcagcgcagtacgacacgaccggtgctcgatttagcacacgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtccaccatcctcctgcatggactccagcagtgacgttggtnctttangtctttgtctccgtcggtaccaacaccacccgtgacaaaccgacccccaaatccatctagttttcgagtacacgtacgccggtcctacgtacgggtcctagtactcgtcttctccgtcgtctacgtacgtcgtacgacacgaccggtcctccgtacgtccgtcgtcgtcggacctcgagtcnggagagtagcggtntagtacttacgacgtcgactacctntaatacncggacgacgaacgtacgttaagttacggggtttcggggttaccgggacggtacgggtaacgtaagggtccgtaccgtccgtacgtacgaccggacccgtacggtcccgtcccggtccccgtacgtaccctcgtccgttcccgtcccccg

SEQ ID NO: 314802 - DNA, 576 bp, Homo sapiens
  misc_feature: GZ8MTXP02I6VAV.52.35.D02.1.454.CMB.2.raw
  modified_base (200)..(200): a, c, t, g, unknown or other
  misc_feature (200)..(200): n is a, c, g, or t
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtctccgagggganagacgccacctctcctgcaggaccagtcagagtatagcaatgttactagcctggtaccagcagactccnggccaggcctccccgaggcctccnatcgtagtggtacnccgtacgagcgacgggccacgtggcactccagacctggtcagtcganaggtggtctgggacagtcctgactctanacntcagcgaggngagtctaggaggtattcgntagtgttattgttagctagtaccgtatacggttaggtacggtacacgtacgttacgttacggtttacggaccgtaaacgggggtaacctaaggtaccggttaggaaacgtaagttaaccgaaaacggtaacgtggtacggtacgtacggaccgtaacttacg

SEQ ID NO: 314803 - DNA, 613 bp, Homo sapiens
  misc_feature: GZ8MTXP02GFDTE.52.35.D02.1.454.CMB.2.raw
  modified_base (242)..(242): a, c, t, g, unknown or other
  misc_feature (242)..(242): n is a, c, g, or t
tcagcgcagtacgacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtncttatgtactttgtctctgtaccaacaccacctgacaaacgccccaaactcatctattttgacgtcactaacgcgcctcgacgggtcctgactcgtcttctccgtgctacgacgtctagacaccgaccggtccctccgtacgtacccgtctcgtcgggtcctacgaggctaggagtagtcggacggtctagtacttactacgtcgacctacctctagtatcgacgacggacgtaacgtaacggtttaagggttttcgggggttacggacggggtaacgggtaaccgtacgggttacgtaccgtacgtacgtacgaaccggccgaacgccgtcccgaccccgttcggtacctcgtccgttaccgttaccccg

SEQ ID NO: 314804 - DNA, 667 bp, Homo sapiens
  misc_feature: GZ8MTXP02ICYZX.52.35.D02.1.454.CMB.2.raw
tcagcgcagtacgacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagccctcctccgcgtccgggtctcctggacagtcagtcaccatctcctgcatggatccagcaggtgacgttggtgcttatgtactttgtctcctggtaccaacaccaccctgacaaacgcccccaaatcaatctattttgaggtacactaagccgcctgacgggtcctgactcgcttctccgtcgtctcgtaagtctacggactaccgacggtccctcccgttacgaccccgttcgtccgttcgggaccttccgaacggtccgtgacggtatacggaacgggtctacgtaatttacccgtacgttacgacctaccgtactactacgtgacgtaggaccgaaactaacgttaaacgggttttcggggtttaccgggacggtaacgggtacgtaaaacgggttcgaaacccgtttcctacgggaaccctacggtaccccgaaaggtcccgttaccgcccccggttcggtaccctaccgttccgtttacccgttaaccccccg

SEQ ID NO: 314805 - DNA, 651 bp, Homo sapiens
  misc_feature: GZ8MTXP02FMGCQ.52.35.D02.1.454.CMB.2.raw
  modified_base (365)..(365): a, c, t, g, unknown or other
  misc_feature (365)..(365): n is a, c, g, or t
tcagcgcagtacgacacgaccggtgctcgatttagcacacgatagttgggtttgggggggtctcaggaggcagcgctctcaggacgtcaccaccatggcctgggctctgctcctcctcacccctcctcactcagggcacagggtcctgggcccagtctgccctgactcagcctccctccgcgtccgggtctcctggacagtcagtcaccatctcctgcactggatccagcagtgacgttggtgcttatgtactttgtctcctggtaccaacaccaccctggacaaaccgacccccaactcatctattttgaggtcaacgtaacgccggcctgacggggtccctagactccgtcttctccgtggcncgagtctggacaccaccggccctccgtcgtaccgtctcgtcgggcctacgaggtcgtaggaggacgtaggacggcgttagtacttacctacgtacgaccacctactagtactcgcgacggaccgtaacgtaaacggtttaggtttacgggggtttacggacggggtaaacggggtaccgtaaagggtccgtacccggtcccgttaaccgtccgaaccggcccgtaaacgggcccgtacccggtcccccgtaccggtcctaaccttcccgttaccgtttaccccccg

SEQ ID NO: 314806 - DNA, 606 bp, Homo sapiens
  misc_feature: GZ8MTXP02IDLKV.52.35.D02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (452)..(452): a, c, t, g, unknown or other
  misc_feature (452)..(452): n is a, c, g, or t
tcagcgcagtacgacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtncttangtactttgtctctggtaccaacaccaccctggacaaacgcccccaaatcatctattttgagtacataagcgccctgacgggtcctgatcgtcttctccgtggctcgaagtctcggacaccgccggtcctcccctagacccgttctcgttcgggcctacccgaggctaggaggtatggacggtctagtattacctactcgctaccntaatatcgacgacggacaaacgtaaacgttagggtttttacgggggtttcggacggggtaacggtaacccgtaagggttccggaaaccttccgaacgtaccgacgacccaaggccgtccgccccgttcggctaccgttccgttccggttccccc

SEQ ID NO: 314807 - DNA, 620 bp, Homo sapiens
  misc_feature: GZ8MTXP02FR92A.52.35.D02.1.454.CMB.2.raw
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
tcagcgcagtacgacacgaccggtgctcgatttagcacacgatagttgggtttggggggggtctcaggaggcagcgctctcaggacgtcaccaccatggcctgggctctgctcctcctcaccctcctcactcagggcacagggtcctgggcccagtctgccctgactcagccctcctccgcgtccgggtctcctggacagtcagtcaccatctcngcactggactccagcagtgtacgttggngtcttatgtactttgtctctcgtaccaacaccaccgtgacaaaccgaccccaactacacttactagttttgacgtacacgtaacgccgcctcgacgggtcctgactcgtcttctcgtcgctacgtaagtcgtacgacaccgaccgtcctccgtaccgtaccgtcgtcgtcggcctcgacggtcgtagaggtacgtggacgtctaggtacttacgtacgtacgtacctactactagtacgtcggacaacggacgtaacgtaaacggtttacggggtttcggggttacgacggggacggtaacgtacgggtaccgtaccgtcgtaacgtcgacgaccgaacgtccgtcccgccctacggtcctactccgttacctcccc

SEQ ID NO: 314808 - DNA, 658 bp, Homo sapiens
  misc_feature: GZ8MTXP02GTZM3.52.35.D02.1.454.CMB.2.raw
  modified_base (243)..(243): a, c, t, g, unknown or other
  misc_feature (243)..(243): n is a, c, g, or t
tcagcgcagtacgacacgaccggtgctcgatttagcacacgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctctgcatgatccagcagtgtacgttggtntcttagtgtactttgtcttcctggtaacccaacaccacccgtcgacaaccgacccccaatctatctattttgagtacactacgccgcctcgacgggtcctgtactcgtcttcgtccgtcgctcgactcgtcgtacaccgacgtccctccgtcgaccgtcgtcgtcggccgtcgaggtcgtaggagtacgtggacggtctagttacttactacgtcaacctacctactaatgtacgacgtaacggacgtaacgttaaacgtttacgggggtttcgggggtttacgggacggggtaaccggtacggttaacgggtccgtaaaccccggttcctaaaccgggtccaaccggacccggtaacggtcccgtcccgtccccggttacggttcctaccggttcccgtttcccgttccccccg

SEQ ID NO: 314809 - DNA, 562 bp, Homo sapiens
  misc_feature: GZ8MTXP02G4623.52.35.D02.1.454.CMB.2.raw
  modified_base (201)..(201): a, c, t, g, unknown or other
  misc_feature (201)..(201): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (404)..(404): a, c, t, g, unknown or other
  misc_feature (404)..(404): n is a, c, g, or t
tcagcgcagtacgacacgaccggtgctcgatttagcacacgatagttgggtttggggagagctgctcagttaggacccagagggaaccatggaaaccccagcgcagcttctcttcctcctgctactctggctcccagatatcaccggagaaattgtgttgacgcagtctccaggcaccctgtctctgtcctccgagggganagagcccaccctctcctgcaggaccagtcagagttattagctaactgttacttagcctggtaccagcagatcngcagctccagctcctatctatggtncgtcagcagggccagtcggcactcccagaccctggttcagtcggcaggttcgggcgtagggactagtaccttcacgtctacaccgatccgagcgagggtgacgcngtagtagtttgcgtagtgttattagttcgttacgaggtactacgttagtaggtacggtacacgtagtacttacgtttacggaccgtaggggaacccaaggtcgttacgacgtacgttaacgaaacgtacgtacggtagacgtacgtaccacgttaccg

SEQ ID NO: 314810 - DNA, 588 bp, Homo sapiens
  misc_feature: GZ8MTXP01BGKXO.2.15.B04.1.454.CMB.2.raw
  modified_base (503)..(503): a, c, t, g, unknown or other
  misc_feature (503)..(503): n is a, c, g, or t
tcagacgctcgacacacgaccggtgctcgatttagacagtatatatccgcgggggggagaggagccccagccctgagattcccaggtgtttccattcggtgatcagcactgaacacagagaacgcaccatggagtttggactgaactgggttttccttgttgctatttaaaaggtgtccagtgtgaggtgcagctggtggagtcgtgggggaggcttggtacagccgtgggggtccctgcgactctcctgtgcagcctctggattcacctttgatgatataacattcactgggtcctcaagcgtccggggaaggtctgggagtgggtctcgtgttattacgttgggatggagcaactaccatactatgcaagactcgtgtgcaggggccattcacccacctccaagacgacaaataccaagaaacctccctaatactctagacaaatgggaaactaggtctgagcgcgtggaacggactacccggtccttggtaatttaacgnggttgaacgttaaaaagggggtgtacgggaccggacgaccgtaacttaacgttaaccgtacgtccgggttacgtcgggccgtcgg

SEQ ID NO: 314811 - DNA, 630 bp, Homo sapiens
  misc_feature: GZ8MTXP01AGIRA.2.15.B04.1.454.CMB.2.raw
  modified_base (288)..(288): a, c, t, g, unknown or other
  misc_feature (288)..(288): n is a, c, g, or t
tcagacgctcgacacacgaccggtgctcgatttagacagtatatatccgcgggggggagaggagccccagccctgagattcccaggtgtttccattcggtgatcagcactgaacacagagaacgcaccatggagtttggactgaactgggttttccttgttgctattttaaaaggtgtccagtgtgaggtgcagctggtggaggtcgtggggggaggcttggtacaggccgtgggggtccctgcgactctcctgtgcagcctgtggtattcaccttgatgatataacnttcacgtgggtccgtcaaggcgtccgggggaaggtctgggagtgggtctcgttgtttatttacgtgggatggagcaactacatactatcgcaagactcgtgtcgcgacggggcctattccaaccctaccctaccaaagacgaaccaaacttacccaaacgaacccttcctaatactctagaactaaagtcggaaactggtactggaacgtcgcgtaggaaccggacctacccgttcctttagtacttaaccgaggttacgaaacggaaaagggtacgtagggacccgggacttaccggtaactaacttccgtacgtccggttagtcgggttaacggtccggg

SEQ ID NO: 314812 - DNA, 536 bp, Homo sapiens
  misc_feature: GZ8MTXP02I1E4X.2.15.B04.1.454.CMB.2.raw
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
  modified_base (424)..(424): a, c, t, g, unknown or other
  misc_feature (424)..(424): n is a, c, g, or t
  modified_base (436)..(436): a, c, t, g, unknown or other
  misc_feature (436)..(436): n is a, c, g, or t
  modified_base (471)..(471): a, c, t, g, unknown or other
  misc_feature (471)..(471): n is a, c, g, or t
  modified_base (488)..(488): a, c, t, g, unknown or other
  misc_feature (488)..(488): n is a, c, g, or t
tcagacgctcgacacacgaccggtgctcgatttagacagtatatatccgcggggggagaggagccccagccctgagattcccaggtgtttccattcggtgatcagcactgaacacagagaacgcaccatggagtttggactgaactgggttttccttgttgctattttaaaaggtgtccagtgtgaggtgcagctggtggagtcgtgggggaggcttgggtacagccgtggggggtccctgcgactctcctgtgcagcctctggattcacctttgatgattataacattcactgggtcctnaagctccggggaggtctggagtggtctctgttattacgttgggatggagcaactaccatactatgcagactntgtgcagggccgattcaccactccagagacataccagaacctcctatatcngacaaatgaacngtctgagcgctgacggacaccgtcttgtacttacngttacgacgaaaagggntacgggacggacgaccgctataccgtacgtccggtctcggacgttcgg

SEQ ID NO: 314813 - DNA, 662 bp, Homo sapiens
  misc_feature: GZ8MTXP02HASXT.2.15.B04.1.454.CMB.2.raw
tcagacgctcgacacacgaccggtgctcgatttagacagtatatatccgcgggggggagaggagccccagccctgagattcccaggtgtttccattcggtgatcagcactgaacacagagaacgcaccatggagtttggactgaactgggttttccttgttgcttattttaaaaggtgtccagtgtgaggtgcagctggtggagtcgtgggggaggcttggtacagccgtgggggtccctgcgactctcctgtgcagcctctggtattcacctttgatgtattaataactatttacacgttcgggtccgtacaacggtccggtaccgggggaaaggggtcgtggggaggttcggggtcttcgttagtttagtttacggttggggatagggagacctaaactacctaattactatgactagacttctgtcgcgacggggccgtatccacccacctaccaagacaaactaaactaacccgaaactaaaccctacccttaatactactagacctaaaagtcgaaactagtcgagacgcgactaggaacggacctaccgtaccgtttatactttacgtggtagaaacggaaaagggtctcggggaaccggacgaccgtaattaacgttaaccgtacgttccggtacgtacgggtacgttaccgggg

SEQ ID NO: 314814 - DNA, 537 bp, Homo sapiens
  misc_feature: GZ8MTXP02GS5F0.17.23.C01.1.454.CMB.2.raw
  modified_base (372)..(372): a, c, t, g, unknown or other
  misc_feature (372)..(372): n is a, c, g, or t
  modified_base (427)..(427): a, c, t, g, unknown or other
  misc_feature (427)..(427): n is a, c, g, or t
  modified_base (469)..(469): a, c, t, g, unknown or other
  misc_feature (469)..(469): n is a, c, g, or t
tcagcgtagactagcacgaccggtgctcgatttagtacacgtgattagggattgggggagagaggagccttagccctagattccaaggcctatccacttggtgatcagcactgagcaccgaggattcaccatggaactggggctccgctgggttttccttgttgccctttttggaggtgtccaatgtgaggtgcagctggtggaatcgtgggggaggcctggtcaagccgtggggggtccctgagactctcctgtacagcctctggattcaccttcaagaactacaacatgcactggtccgccaggctccgaggggaagggactgggagtgggtctcatccattagtagtggaagtagtaccatatattcgnagagtcagtgaagggccgttcacatctcagagacaacgcaaagactcactcttcnacaaatgaacggctagggacccaagacacggctgtctattcngtgcgagtaggacgggggagtagtaacgtgactggtagaaggtctaatttggactacgtactctaacg

SEQ ID NO: 314815 - DNA, 528 bp, Homo sapiens
  misc_feature: GZ8MTXP02GHG95.17.23.C01.1.454.CMB.2.raw
  modified_base (369)..(369): a, c, t, g, unknown or other
  misc_feature (369)..(369): n is a, c, g, or t
  modified_base (422)..(422): a, c, t, g, unknown or other
  misc_feature (422)..(422): n is a, c, g, or t
  modified_base (463)..(463): a, c, t, g, unknown or other
  misc_feature (463)..(463): n is a, c, g, or t
  modified_base (498)..(498): a, c, t, g, unknown or other
  misc_feature (498)..(498): n is a, c, g, or t
tcagcgtagactagcacgaccggtgctcgatttagtacacgtgattagggattgggggagagaggagccttagccctagattccaaggcctatccacttggtgatcagcactgagcaccgaggattcaccatggaactggggctccgctgggttttccttgttgccctttttggaggtgtccaatgtgaggtgcagctggtggaatcgtgggggaggcctggtcaagccgtggggggtccctgagactctcctgtacagcctctggattcaccttcaagaactacaacatgcactgggtccgccaggctccgaggggaaggactggagtgggtctcatccattagagtggaagtagtaccatatatcgnagatcagtgaagggccgttcacatctcagagacaacgcaaagactcactcttngacaaatgaacgctagggacccaagacacgctgtctattcngtgcgagaggacggggtatagtaactgactgtagngtactaagtttcggacttactactctaacg

SEQ ID NO: 314816 - DNA, 692 bp, Homo sapiens
  misc_feature: GZ8MTXP02GH7RA.17.23.C01.1.454.CMB.2.raw
  modified_base (260)..(260): a, c, t, g, unknown or other
  misc_feature (260)..(260): n is a, c, g, or t
tcagcgtagactagcacgaccggtgctcgatttagtacacgtgattagggattggggtctgagagaggagccttagccctagattccaaggcctatccacttggtgatcagcactgagcaccgaggattcaccatggaactggggctccgctgggttttccttgttgccctttttggaggtgtccaatgtgaggtgcagctggtggaatcgtgggggaggcctggtcaagccgtgggggtccctgagactctcctgtacngcctctggattcaccttcaagaaactacaacatgcactgggtcccgcaggctccgaggggaagggactggagtgggtctcatccattagtagtggaagtagtacatattacttccgcagagtcaggtgaacggggtcccggttacaccatcctacccgagacgacaacgaccaaacgaacctcaacttctttactacggacaaagtcggaaccggtacccgtacgggggaaacccccgaaaggaacccgaccgggtacgttacggttaccttaacgtttttccgtaggttacggtaccgggtaaagggaacgggggtaaaccggggggtaaggttaaacgggttaaaacccgtgggttaccgttaaggggttaaggtaacggggtttaccgttaaaaggtttttacggggaaccgtttaaccgtttaaaccg

SEQ ID NO: 314817 - DNA, 612 bp, Homo sapiens
  misc_feature: GZ8MTXP02I83HJ.17.23.C01.1.454.CMB.2.raw
  modified_base (299)..(299): a, c, t, g, unknown or other
  misc_feature (299)..(299): n is a, c, g, or t
  modified_base (427)..(427): a, c, t, g, unknown or other
  misc_feature (427)..(427): n is a, c, g, or t
tcagcgtagactagcacgaccggtgctcgatttagtacacgtgattagggattgggggagagaggagccttagccctagattccaaggcctatccacttggtgatcagcactgagcaccgaggattcaccatggaactgggctcgctgggttttccttgttgccttttggaggtgtccaatgtgaggtgcagctggtggaatcgtgggggagctggtcaagccgtggggggtccctgagactctcctgtacagcctcgtggattcaccttcaaagaactacaacatgcacgtgggtccnccaggctccgaggggaaggcgtggagtggtctcgatccaattagtagtaggaaagttgttaaccataatacgttccgacagtacgtcaaggtaggaaacggggtccgttacaaccattccacaggaanaaccaacgaccaaagaactcaacttcttacagactaaaagtcgaaaccgggctacgggaaacccgaaggaaccacggcttacgtcttacgttcgtagcggacgtaggacggggacggggtataaacggtacgtcgacgttagaggtaacgtacgttaatttcggacctttagtaactacgaaccg

SEQ ID NO: 314818 - DNA, 660 bp, Homo sapiens
  misc_feature: GZ8MTXP02FXNRU.17.23.C01.1.454.CMB.2.raw
  modified_base (375)..(375): a, c, t, g, unknown or other
  misc_feature (375)..(375): n is a, c, g, or t
tcagcgtagactagcacgaccggtgctcgatttagtacacgtgattagggattgggggagagaggagccttagccctagattccaaggcctatccacttggtgatcagcactgagcaccgaggattcaccatggaactggggctccgctgggttttccttgttgcccttttggaggtgtccaatgtgaggtgcagctggtggaatcgtgggggaggcctggtcaagccgtggggggtccctgagactctcctgtacagcctctggattcaccttcaaagaactacaacatgcactcgggtccgccaggcctccgaggggaagggactggagtgggtctcatccattagtagtggaagtagtaccatatattccgnagagtcagtggaaagggtccgttacaccatctaccagacgacaacgaccaaagactcacttcttcagactaaagtcgaaaccggccgtacggggaaccccaaaggaccaccgggtcttacggtacctttaagtttccgtaggtacggaccggtaaaggacgggggaaaccggggggtaattaaacgggttaaacgtcggtaccgttagggttaaagggtaacggggtttacctttaaaaggtttttcgggaacccttttaaacgttaacgtacccttaaaaccgg

SEQ ID NO: 314819 - DNA, 369 bp, Homo sapiens
  misc_feature: GZ8MTXP01EISMF.15.26.C04.1.454.CMB.2.raw
  modified_base (330)..(330): a, c, t, g, unknown or other
  misc_feature (330)..(330): n is a, c, g, or t
  modified_base (367)..(369): a, c, t, g, unknown or other
  misc_feature (367)..(369): n is a, c, g, or t
tcagtctacgtagccacgaccggtgctcgatttagtctagcgactttgggtttgggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctganctacgtagactgagcgggcctggcaaggcgcaatagnnn

SEQ ID NO: 314820 - DNA, 366 bp, Homo sapiens
  misc_feature: GZ8MTXP01EHSWP.15.26.C04.1.454.CMB.2.raw
  modified_base (366)..(366): a, c, t, g, unknown or other
  misc_feature (366)..(366): n is a, c, g, or t
tcagtctacgtagccacgaccggtgctcgatttagtctagcgactttgggtttgggctttccctggtatcagcagaaaccagggaaagcccctaacctcctaatctatgatgcctccagtttggagagtgggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtagactgagcgggcctggcaaggcgcaaatgn

SEQ ID NO: 314821 - DNA, 373 bp, Homo sapiens
  misc_feature: GZ8MTXP01D4IOJ.15.26.C04.1.454.CMB.2.raw
  modified_base (370)..(373): a, c, t, g, unknown or other
  misc_feature (370)..(373): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaaggggaccagggtggatatacaaacgaactgtggctgcaccatctgtcttcatcttcccgccatctgagctacgtagactgagcgggctgggcaaggcgcaatagnnnn

SEQ ID NO: 314822 - DNA, 370 bp, Homo sapiens
  misc_feature: GZ8MTXP01D67RW.15.26.C04.1.454.CMB.2.raw
  modified_base (368)..(370): a, c, t, g, unknown or other
  misc_feature (368)..(370): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgctaacttattactgccaacagtataatagcaattctccgtggacgttcggccaagggaccagggtgatatacaaacgaactgtggctgcaccatctgtcttcatcttcccgcatctgagctacgtagactgagcgggctgggcaaggcgcaatagnnn

SEQ ID NO: 314823 - DNA, 373 bp, Homo sapiens
  misc_feature: GZ8MTXP01BAGVW.15.26.C04.1.454.CMB.2.raw
  modified_base (369)..(373): a, c, t, g, unknown or other
  misc_feature (369)..(373): n is a, c, g, or t
tcagtctacgtagccacgaccggtgctcgatttagtctagcgactttgggtttgggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaaggggaccagggtggatatcaaacgaactgtggctgcaccatctgtctttatccttcccgccatctgagctacgtagactgagcgggctcggcaaggcgcataagnnnnn

SEQ ID NO: 314824 - DNA, 371 bp, Homo sapiens
  misc_feature: GZ8MTXP01D1X61.15.26.C04.1.454.CMB.2.raw
  modified_base (367)..(371): a, c, t, g, unknown or other
  misc_feature (367)..(371): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaaggggaccagggtggatatcaaacgaactgtggctgcaccatctgtcttcatccttcccgcatctgagctacgtagactgagcggctggcaaggcgcaatagnnnnn

SEQ ID NO: 314825 - DNA, 256 bp, Homo sapiens; identical to SEQ ID NO: 31783
  misc_feature: GZ8MTXP01D4ID5.15.26.C04.1.454.CMB.2.raw
  modified_base (256)..(256): a, c, t, g, unknown or other
  misc_feature (256)..(256): n is a, c, g, or t

SEQ ID NO: 314826 - DNA, 370 bp, Homo sapiens
  misc_feature: GZ8MTXP01A90QZ.15.26.C04.1.454.CMB.2.raw
  modified_base (338)..(338): a, c, t, g, unknown or other
  misc_feature (338)..(338): n is a, c, g, or t
  modified_base (359)..(359): a, c, t, g, unknown or other
  misc_feature (359)..(359): n is a, c, g, or t
  modified_base (367)..(370): a, c, t, g, unknown or other
  misc_feature (367)..(370): n is a, c, g, or t
tcagtctacgtagccacgaccggtgctcgatttagtctagcgactttgggtttgggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatccttcccgcatctgagctacgtanactgagcgggctggcaaggcncaaatagnnnn

SEQ ID NO: 314827 - DNA, 375 bp, Homo sapiens
  misc_feature: GZ8MTXP01CBSFP.15.26.C04.1.454.CMB.2.raw
  modified_base (371)..(375): a, c, t, g, unknown or other
  misc_feature (371)..(375): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagtattttgactaacttattactgaccaacagtataatagctaattctcgtggacgttcggccaagggaccagggtggatatcaaacgaactgtggctgcaccatctgtcttcatcttcccgccatctgagctacgtagctgagcgggcctggcaaggcgcaatagnnnnn

SEQ ID NO: 314828 - DNA, 377 bp, Homo sapiens
  misc_feature: GZ8MTXP01EYOO0.15.26.C04.1.454.CMB.2.raw
  modified_base (340)..(340): a, c, t, g, unknown or other
  misc_feature (340)..(340): n is a, c, g, or t
  modified_base (371)..(377): a, c, t, g, unknown or other
  misc_feature (371)..(377): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaaggggaccagggtggatatacaaacgaactgtggctgcaccatctgtcttcatcttcccgcatctgagctacgtanactgagcgggcctgggcaaggcgcaaatagnnnnnnn

SEQ ID NO: 314829 - DNA, 380 bp, Homo sapiens
  misc_feature: GZ8MTXP01BWESX.15.26.C04.1.454.CMB.2.raw
  modified_base (338)..(338): a, c, t, g, unknown or other
  misc_feature (338)..(338): n is a, c, g, or t
  modified_base (376)..(380): a, c, t, g, unknown or other
  misc_feature (376)..(380): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagtattttgactaacttattactgaccaactagtataatagctaattctccgtggacgttcggccgaagggaccagggtggatatacaaacgaactgtggctgcaccatctgtcttcactctcccgcatctganctacgtagactggacgcggctggacaaggcgcaatagnnnnn

SEQ ID NO: 314830 - DNA, 370 bp, Homo sapiens
  misc_feature: GZ8MTXP01D18TD.15.26.C04.1.454.CMB.2.raw
  modified_base (365)..(370): a, c, t, g, unknown or other
  misc_feature (365)..(370): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtctcatcttcccgcatctgagctacgtagactgagcgggctggcaaggcgcaatagnnnnnn

SEQ ID NO: 314831 - DNA, 368 bp, Homo sapiens
  misc_feature: GZ8MTXP01BI08U.15.26.C04.1.454.CMB.2.raw
  modified_base (359)..(359): a, c, t, g, unknown or other
  misc_feature (359)..(359): n is a, c, g, or t
  modified_base (365)..(368): a, c, t, g, unknown or other
  misc_feature (365)..(368): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagccctgcagcctgaagtatttttgctaacttattactgccaacagtataatagcaattctcgtgacgttcggccaagggaccagggtgatatcaaacgactgtggctgcacatctgtcttcatccttcccgcatctgagctacgtagactgagcggctggcaagccgnaatagnnnn

SEQ ID NO: 314832 - DNA, 371 bp, Homo sapiens
  misc_feature: GZ8MTXP01DAEBW.15.26.C04.1.454.CMB.2.raw
  modified_base (367)..(371): a, c, t, g, unknown or other
  misc_feature (367)..(371): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagctaattctccgtggacgttcggccaagggaccagggtggatatcaaacgactgtggctgcaccatctgtcttcatcttccccgcatctgatctacgtagactgagcgggctggcaaggcgcaatagnnnnn

SEQ ID NO: 314833 - DNA, 377 bp, Homo sapiens
  misc_feature: GZ8MTXP01D515S.15.26.C04.1.454.CMB.2.raw
  modified_base (335)..(335): a, c, t, g, unknown or other
  misc_feature (335)..(335): n is a, c, g, or t
  modified_base (372)..(377): a, c, t, g, unknown or other
  misc_feature (372)..(377): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagatttttgcaacttattactgaccaacagtaataatagcaattctccgtggacgttcggccaagggaccagggtgatatacaaacgaactgtggctgcaccatctgtcttcactcttcccgccatctganctacgtagactgagcgggctggcaaggcgcaaatagnnnnnn

SEQ ID NO: 314834 - DNA, 376 bp, Homo sapiens
  misc_feature: GZ8MTXP01DZHHR.15.26.C04.1.454.CMB.2.raw
  modified_base (372)..(376): a, c, t, g, unknown or other
  misc_feature (372)..(376): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagatttttgctaacttattactgaccaacagtaataatagctaattctccgtggacgttcggccaaggggaccagggtggatatcaaacgaactgtggctgcacatctgtctcatccttcccgcatctgacgctacgtagactgagcggctggacaaggcgcaatagnnnnn

SEQ ID NO: 314835 - DNA, 409 bp, Homo sapiens
  misc_feature: GZ8MTXP01D7T01.15.26.C04.1.454.CMB.2.raw
  modified_base (310)..(310): a, c, t, g, unknown or other
  misc_feature (310)..(310): n is a, c, g, or t
  modified_base (399)..(409): a, c, t, g, unknown or other
  misc_feature (399)..(409): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagtatttttgactaacttattacctgaccaacagtaataatagactaattctccggtggtaccgttcggaccgaaggggaccgagggtggatatacaaacgactgngctgcaccatctgtctcacttcctccccgacatctgacgtctacggtagactggacgcggggcctgggacaaggggcctacaaagtagnnnnnnnnnnn

SEQ ID NO: 314836 - DNA, 379 bp, Homo sapiens
  misc_feature: GZ8MTXP01DI1BF.15.26.C04.1.454.CMB.2.raw
  modified_base (373)..(379): a, c, t, g, unknown or other
  misc_feature (373)..(379): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgctaacttattactgccaacagtataatagcaattctccgtggacgttcggaccaagggaccagggtggatatacaaacgaactgtggctgcaccatctgtcttcatcttcccgccatctgacgctcgtagactgaggcgggctggacaaggcgacaatagnnnnnnn

SEQ ID NO: 314837 - DNA, 405 bp, Homo sapiens
  misc_feature: GZ8MTXP01A15EB.15.26.C04.1.454.CMB.2.raw
  modified_base (344)..(344): a, c, t, g, unknown or other
  misc_feature (344)..(344): n is a, c, g, or t
  modified_base (396)..(405): a, c, t, g, unknown or other
  misc_feature (396)..(405): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagccctgaagtattttgctaacttattactgaccaacagttaataatagctaattctcgtggacgttcggacgaagggaccgagggtggatatacaaacgaatgtggctgaccaccatctgtcttcacttcctccccgccatctgancctaggtatacgtggacggcggggcctgggacgtaaagggccgacaagtagnnnnnnnnnn

SEQ ID NO: 314838 - DNA, 372 bp, Homo sapiens
  misc_feature: GZ8MTXP01AJJIN.15.26.C04.1.454.CMB.2.raw
  modified_base (365)..(372): a, c, t, g, unknown or other
  misc_feature (365)..(372): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagccctgcagcctgaagattttgcaacttatactgccaacagtataatagcaattctcgtgacgttcggcaagggaccagggtggatatacaaacgaactgtaggctgcaccatctgtcttcatctccccgcatctgagtctacgtagactgagcgggctggcaagcgcaatagnnnnnnnn

SEQ ID NO: 314839 - DNA, 396 bp, Homo sapiens
  misc_feature: GZ8MTXP01DC56B.15.26.C04.1.454.CMB.2.raw
  modified_base (234)..(234): a, c, t, g, unknown or other
  misc_feature (234)..(234): n is a, c, g, or t
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (391)..(396): a, c, t, g, unknown or other
  misc_feature (391)..(396): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcacatccgcagcctgcagcctgaagtattttgctaaacttattactgacccaanagtaataatagactaattctccgtggacgttcggaccaagggaccagggtgatatacaaacgactgtgctgcaccatctgtcttacgacttccgtccnccattccgngatctaacggtagactaggacggtccggctaggacaaggccgtanaanannnnnn

SEQ ID NO: 314840 - DNA, 368 bp, Homo sapiens
  misc_feature: GZ8MTXP02GA8CG.15.26.C04.1.454.CMB.2.raw
  modified_base (360)..(360): a, c, t, g, unknown or other
  misc_feature (360)..(360): n is a, c, g, or t
  modified_base (366)..(368): a, c, t, g, unknown or other
  misc_feature (366)..(368): n is a, c, g, or t
tcagtctacgtagccacgaccggtgctcgatttagtctagcgactttgggtttggggctttccctggtatcagcagaaaccagggaaagccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtagactgagcgggcctggcaaggcncatagnnn

SEQ ID NO: 314841 - DNA, 370 bp, Homo sapiens
  misc_feature: GZ8MTXP02IW5A4.15.26.C04.1.454.CMB.2.raw
  modified_base (368)..(370): a, c, t, g, unknown or other
  misc_feature (368)..(370): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtgcatttgggacagaattcactctcaccatccgcagcctgcagcctgaagattttgcaacttattactgccaacagtataatagcaattctccgtggacgttcggccaaggggacccagggtggatatcaaacgaactgtggctgcaccatctgtcttcatcttcccgccatctgagctacgtagactgagccgggctggcaaggcgcatgnnn

SEQ ID NO: 314842 - DNA, 362 bp, Homo sapiens
  misc_feature: GZ8MTXP02ILVPF.15.26.C04.1.454.CMB.2.raw
  modified_base (360)..(362): a, c, t, g, unknown or other
  misc_feature (360)..(362): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcacatctgtctcatcttcccgcatctgagctacgtagactgagcggctggcagcgcatagnnn

SEQ ID NO: 314843 - DNA, 366 bp, Homo sapiens
  misc_feature: GZ8MTXP02IRDHR.15.26.C04.1.454.CMB.2.raw
  modified_base (358)..(358): a, c, t, g, unknown or other
  misc_feature (358)..(358): n is a, c, g, or t
  modified_base (364)..(366): a, c, t, g, unknown or other
  misc_feature (364)..(366): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttccgccatctgagctacgtagactgagcggctggcaaggcncatagnnn

SEQ ID NO: 314844 - DNA, 368 bp, Homo sapiens
  misc_feature: GZ8MTXP02GUQ2R.15.26.C04.1.454.CMB.2.raw
  modified_base (366)..(368): a, c, t, g, unknown or other
  misc_feature (366)..(368): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcgaccatctgtcttcatcttcccgccatctgagctacgtagactgagcggctggcaaggcgcatagnnn

SEQ ID NO: 314845 - DNA, 367 bp, Homo sapiens
  misc_feature: GZ8MTXP02F1LRI.15.26.C04.1.454.CMB.2.raw
  modified_base (366)..(367): a, c, t, g, unknown or other
  misc_feature (366)..(367): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaaggggaccagggtggatatcaaacgaactgtggctgcaccatctgtcttcatcttcccgccatctgagctacgtagactgagcggctggcaaggcgcatagnn

SEQ ID NO: 314846 - DNA, 374 bp, Homo sapiens
  misc_feature: GZ8MTXP02J3E86.15.26.C04.1.454.CMB.2.raw
  modified_base (341)..(341): a, c, t, g, unknown or other
  misc_feature (341)..(341): n is a, c, g, or t
  modified_base (373)..(374): a, c, t, g, unknown or other
  misc_feature (373)..(374): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaaggggaccaggggtggatatcaaaacgaactgtggctgcaccatctgtcttcatcttcccgccatctgagctacganacctggagcggggcctggcaagggcgcatagnn

SEQ ID NO: 314847 - DNA, 370 bp, Homo sapiens
  misc_feature: GZ8MTXP02JMXHR.15.26.C04.1.454.CMB.2.raw
  modified_base (367)..(370): a, c, t, g, unknown or other
  misc_feature (367)..(370): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaaggggaccagggtggatatcaaacgaactgtggctgcaccatctgtcttcatcttcccgccatctgagctacgtagactgagcggcctggcaaggcgcatagnnnn

SEQ ID NO: 314848 - DNA, 374 bp, Homo sapiens
  misc_feature: GZ8MTXP02GHKJL.15.26.C04.1.454.CMB.2.raw
  modified_base (367)..(367): a, c, t, g, unknown or other
  misc_feature (367)..(367): n is a, c, g, or t
  modified_base (370)..(374): a, c, t, g, unknown or other
  misc_feature (370)..(374): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgaccaacagtataatagcaattctccgtggacgttcggccaagggaccagggtggatatcaaacgaactgtaggctgcaccatctgtctcatccttcccgccatctgagctacgtagactgagtcgggcctggcaaggccganatnnnnn

SEQ ID NO: 314849 - DNA, 369 bp, Homo sapiens
  misc_feature: GZ8MTXP02JOYV6.15.26.C04.1.454.CMB.2.raw
  modified_base (335)..(335): a, c, t, g, unknown or other
  misc_feature (335)..(335): n is a, c, g, or t
  modified_base (363)..(369): a, c, t, g, unknown or other
  misc_feature (363)..(369): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttatactgccaacagtataatagcaattctccgtggacgttcggccaaggggaccagggtggatatcaaacgactgtggctgcaccatctgtcttcatctccgcatctgagctacgtanactgagcgggcctggcaaggcgcatagnnnnnnn

SEQ ID NO: 314850 - DNA, 381 bp, Homo sapiens
  misc_feature: GZ8MTXP02IAIOV.15.26.C04.1.454.CMB.2.raw
  modified_base (376)..(381): a, c, t, g, unknown or other
  misc_feature (376)..(381): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggattttgggacagaattcactctcaccatccgcagcctgcagcctgaagattttgcaacttattactgccaacagtataatagcaattctccgtggacgtttcggccaaaggggaccagggtggatatcaaaacgaactgtaggctgcaccatctgtcttcatccttccccgctatctgagctacgtagactgagcgggcctggcaaggcgtcatagnnnnnn

SEQ ID NO: 314851 - DNA, 381 bp, Homo sapiens
  misc_feature: GZ8MTXP02JTAIZ.15.26.C04.1.454.CMB.2.raw
  modified_base (372)..(372): a, c, t, g, unknown or other
  misc_feature (372)..(372): n is a, c, g, or t
  modified_base (377)..(381): a, c, t, g, unknown or other
  misc_feature (377)..(381): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagtattttgctaacttattactgaccaacagtataatagctaattctccgtggacgttcggaccgaagggccgagggtggatatacaaacgaactgtggctgacaccatctgtctcattcctcccgcctatctgagctacgtagactggaggcggcctggcaaggcanatagnnnnn

SEQ ID NO: 314852 - DNA, 425 bp, Homo sapiens
  misc_feature: GZ8MTXP02IP2Y5.15.26.C04.1.454.CMB.2.raw
  modified_base (414)..(425): a, c, t, g, unknown or other
  misc_feature (414)..(425): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagtattttgactaacttatactgccaacagtataatagcaattctccgtggtacgttcggccgaagggaccgagggtagatactacaaacgaactgtaggctgccactatctagtcttcacttcccttccccgccattcctaggtacgtaccgtaacgttacgaaccgttgaacggtccggggccgtcgggaccgaaggcgtacagtagnnnnnnnnnnnn

SEQ ID NO: 314853 - DNA, 389 bp, Homo sapiens
  misc_feature: GZ8MTXP02JIO7Q.15.26.C04.1.454.CMB.2.raw
  modified_base (325)..(325): a, c, t, g, unknown or other
  misc_feature (325)..(325): n is a, c, g, or t
  modified_base (375)..(375): a, c, t, g, unknown or other
  misc_feature (375)..(375): n is a, c, g, or t
  modified_base (381)..(389): a, c, t, g, unknown or other
  misc_feature (381)..(389): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagtattttgactaacttattactgaccaacagtataatagcaattctcgtggtacgttcggaccaagggccagggtgatatacaaacgactgtggctgcacctatctgtctcactcctccnctatctagacgtctacgtacgacgtgacggcggcgtggacgaggccgtanagtagnnnnnnnnn

SEQ ID NO: 314854 - DNA, 387 bp, Homo sapiens
  misc_feature: GZ8MTXP02JEMMM.15.26.C04.1.454.CMB.2.raw
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (367)..(367): a, c, t, g, unknown or other
  misc_feature (367)..(367): n is a, c, g, or t
  modified_base (372)..(387): a, c, t, g, unknown or other
  misc_feature (372)..(387): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggattttgggacagaattcactctcaccatccgcagcctgcagcctgaagatttttgctaacttattacctgaccaaacagtataatagacaattctcgtggacgttcggaccaaggggaccagggtggatatacaaacgaaactgtgctgcaccatctgtctcatctcccgcatcnanctacgtanactgagcggctggacgagcgtanagtannnnnnnnnnnnnnnn

SEQ ID NO: 314855 - DNA, 390 bp, Homo sapiens
  misc_feature: GZ8MTXP02FQ8CW.15.26.C04.1.454.CMB.2.raw
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (380)..(390): a, c, t, g, unknown or other
  misc_feature (380)..(390): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagtattttgctaacttattactgccaacagtataatagctaattctccgtggacgttcggccaagggccagggtgatatacaaagactgtggntgcaccntctgtcttcatcccttcccgcctatctagacgttacgagacctggaggcgggtcctaggccaagggctcaagtagnnnnnnnnnnn

SEQ ID NO: 314856 - DNA, 411 bp, Homo sapiens
  misc_feature: GZ8MTXP02G04GC.15.26.C04.1.454.CMB.2.raw
  modified_base (390)..(390): a, c, t, g, unknown or other
  misc_feature (390)..(390): n is a, c, g, or t
  modified_base (398)..(411): a, c, t, g, unknown or other
  misc_feature (398)..(411): n is a, c, g, or t
tcagtctacgtagccacgaccggtgctcgatttagtctagcgactttgggtttggggctttccctggtatcagcagaaaccagggaaagcccctaacctcctaatctatgatgcctccagtttggagagtggggtcccatctaggttcagcggcagtggatttgggacagaattcactctcaccatccgcagcctgcagcctgaagtatttttgctaacttattactgaccaaacagtaataaatagcaaatttcgtccgtggacgttcggcccaaaggggaccagggtgatatacaaacgaactgtggctgcaccatacgtgtcttcactcccttcccgccatccgtgagtacttaacgtagactcggaggccgggcctggacaaggcncgagtagnnnnnnnnnnnnnn

SEQ ID NO: 314857 - DNA, 564 bp, Homo sapiens
  misc_feature: GZ8MTXP01C3S5N.44.11.A11.1.454.CMB.2.raw
  modified_base (208)..(208): a, c, t, g, unknown or other
  misc_feature (208)..(208): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (328)..(328): a, c, t, g, unknown or other
  misc_feature (328)..(328): n is a, c, g, or t
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattaccngctcgtaggggaaacttgagtgataaatttgcttcctggtatcagcagaggccaggccagccccctangctggtcatcttnagataatagccgcctgacgggactccccgagcgtccttntctcggcctaccgaactcgtagggaaaaccacggccactctagaccatcagcgcaccagcctcgtgangacggctgactattacngtacaggggacgtgggaaagtgactaagtgggtagttcggggcggtacgggaccaagtcgtcggtaaccgttcgtccgggacaccggcccgaacgggttcttccggtcccccgtgggtcctaccgtccttccgtccccgttaacccttccc

SEQ ID NO: 314858 - DNA, 587 bp, Homo sapiens
  misc_feature: GZ8MTXP01D6GP9.44.11.A11.1.454.CMB.2.raw
  modified_base (364)..(364): a, c, t, g, unknown or other
  misc_feature (364)..(364): n is a, c, g, or t
  modified_base (560)..(560): a, c, t, g, unknown or other
  misc_feature (560)..(560): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccgggcctcctctgacctgactcagccatcctcactgtccgtcgtccccaggacacacagtcactattacctgctctaggggaaacttgagtgataattgcttctggtatcagcagagccaggccagcccctatgctggtcatctttacaggtataataacgcgccctacgacgggtactcccgtgacgcgtcttcgtcctcggcctaccaactcgtaacgggaaccnccgggcctactctacgaccatcgacgccgaccgacccacggcctcaggaatgaggtctagactattaactgtacgaaggtaggtagggaaagtgtacgtaaggttgggtacggttcgggcgggaagggaccaggcgtggacccgttcgttcggtacgacggacccgacggttccgtcccggtccccgtcggtaccnccgttccgttccgttcccctaaccccg

SEQ ID NO: 314859 - DNA, 526 bp, Homo sapiens
  misc_feature: GZ8MTXP01DFPFR.44.11.A11.1.454.CMB.2.raw
  modified_base (303)..(303): a, c, t, g, unknown or other
  misc_feature (303)..(303): n is a, c, g, or t
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (508)..(508): a, c, t, g, unknown or other
  misc_feature (508)..(508): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctggggaaacttgagtgataattgcttctggtatcagcagaggccaggccagccccctatgctggtcatctttcaggataataagcggccctnagggatccctgacgcgcttctccnggctccaactcgtacgggaacncggccactctcgaccatcacgccgcgacccagcctctggatgaggctgactattactgtcgagtacggtaggaaagtgacgttaagttgggtagttcgagggtagggaccaaggctgaccgttcgttcggtcacgcccgaggcctcgcccctcggtccncgttctccgttcccgtcc

SEQ ID NO: 314860 - DNA, 543 bp, Homo sapiens
  misc_feature: GZ8MTXP01AYJPO.44.11.A11.1.454.CMB.2.raw
  modified_base (355)..(355): a, c, t, g, unknown or other
  misc_feature (355)..(355): n is a, c, g, or t
  modified_base (394)..(394): a, c, t, g, unknown or other
  misc_feature (394)..(394): n is a, c, g, or t
  modified_base (455)..(455): a, c, t, g, unknown or other
  misc_feature (455)..(455): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctaggggaaacttgagtgataaattgcttctggtatcagcagaggccaggccacgccccctatgctggtcatcttcaggataatagcgccctgagggactcccgtgacgcgtcttctccgtcggctccaactccgtagggaaccncggccactctacgaccatcacgccgcgacccagccctgnggatggagctgactattactgtcgaggtacggtaggaaagtgacgtaagtgggtggtcggnggtacggcaggtcgtcgccgtcgttcggtacgacgcccgacggcctccggccccctcggtccaccgttccgtccgttccccgtaaccc

SEQ ID NO: 314861 - DNA, 647 bp, Homo sapiens
  misc_feature: GZ8MTXP01AQP1C.44.11.A11.1.454.CMB.2.raw
  modified_base (397)..(397): a, c, t, g, unknown or other
  misc_feature (397)..(397): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacgaggggcccggggcctcctctgacctgactcagccatcctcactgtccgtcgtccccaggacacacagtcactattacctgctcgtaggggaaacttgagtgattaattgcttctggtatcagcagacggccaggccacgcccctatcgctggtctattctttacgaggaattaacgtaacggccggaccctacggagggtacctcccgtggacgtcgtctttcctccgtcggtacctacccgtaacgtcggtaacgggaaacccnccgggccctaacgttccgtacgaaccctacgtccgaacgcccgaccgacccacgtcccttcggaggacgtcggacggtctagtacttacgttacgtcggtacgagggtacgggtagggaaagttgtacgttaaggttggggtacggtcgggacggtaggaccgagtcgtacggttccgttcgcgggtcacggcccgacggttccgtcccgccccgtcggtccctaccgttcctcccgttcccctaacccc

SEQ ID NO: 314862 - DNA, 584 bp, Homo sapiens
  misc_feature: GZ8MTXP01CBBC2.44.11.A11.1.454.CMB.2.raw
tcagacagtatatacacgaccggtgctcgatttagctacgactgcaggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctaggggaaaacttgagtgattaaatttgcttcctggtatcagcagaggccaggccacgccccctatgctggtcatcttcaggataatagcgcctcagggactccgtgacgcgcttctcccgtggctaccaactcgtacgggaacctcgggcccactctcgaccagtcacgccgaccgacccacggccctcgtagggacttggaggtctaggaccttagttactggtacgaggtacggtagggaaagtgtacgttaaggttgggtaggttcgggacggggtacggacgaaggcgtcggttaccgttcgcggtacgacgttcccgaggttccgtccgcccccgtcggtcctcttccgtccgttcccctaacccc

SEQ ID NO: 314863 - DNA, 729 bp, Homo sapiens
  misc_feature: GZ8MTXP01BQQXA.44.11.A11.1.454.CMB.2.raw
tcagacagtatatacacgaccggtgctcgatttagctacgactgcaggggctgggcctcaggaagcagcatcggaggtgcctcagccatggcatggatccctctcttcctcggcgtccttgcttactgcacgaggggtccgggcctcctctgacctgactcagccatcctcactcgtccgtcgtcccaggacacacagtcactactacctgctcgtagggtaaacttgagtagattaatttgcttcgtaggtatcagcgaggacgccacggccacgcccctatcgctgtcatttcttacgaaggtaattaacacggccggtcctacgacgggtactccgtgacgtcgtacttctccgtcggacctaccgaacgtccgtaacgggaaaccctccggacctaccgttcgtaccgaccgtactaccgacgcccggacccgaacccgtaccgtccgtacgtacgggtaaccgtaggttaccgggtacgtaacggttaacctttaacggttaacgttacgggtaaccggggtaacgggtttaacgggggtaaacgggttaaacgggttacggttaccgggtttaaagggtttcggggtacgggtttaccggggacgggttaacgggaaaccggtagtccggttacgttaccggttcgttccggtacgaccggttaccgccgttaccgtcccgcccgttcggtcctacggttccttcccggttaacccgtccccg

SEQ ID NO: 314864 - DNA, 580 bp, Homo sapiens
  misc_feature: GZ8MTXP02G7STF.44.11.A11.1.454.CMB.2.raw
  modified_base (317)..(317): a, c, t, g, unknown or other
  misc_feature (317)..(317): n is a, c, g, or t
  modified_base (337)..(337): a, c, t, g, unknown or other
  misc_feature (337)..(337): n is a, c, g, or t
  modified_base (392)..(392): a, c, t, g, unknown or other
  misc_feature (392)..(392): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactatacctgctcgtagggaaacttgagtgataattgcttctgtatcagcagagccagccagccccctatgctgtcatcttcaggataatagcggcctgagggactccctgagcgcttcncctgcctcaactctggaacncggccactctgaccatcagcgcgacccacgcctctgatgaggtctgactattacngtacagtacgtagggaaagtgacgtaagttggggttggttcgggcggtaaggggacccaaaggtccgtacggtacccgttcgtaccgggttccgacggtacccccgaaaggggtccctaaccgggtccccccccgttcggggtaccctaacccgtttcccgttcccggtttacccccctaaccccccg

SEQ ID NO: 314865 - DNA, 532 bp, Homo sapiens
  misc_feature: GZ8MTXP02I2AJE.44.11.A11.1.454.CMB.2.raw
  modified_base (348)..(348): a, c, t, g, unknown or other
  misc_feature (348)..(348): n is a, c, g, or t
tcagacagtatatacacgaccggtgctcgatttagctacgactgcaggggctgggcctcaggaagcagcatcggaggtgcctcagccatggcatggatccctctcttcctcgcgtccttgcttactgcacagggtccgggcctcctctgacctgactcagccatcctcactgtccgtgtccccaggacacacagtcactatacctgctctggggaaacttgagtgataaatttgcttctggtatcagcagaggccaggccagccccctatgctggtcatctttcaggataataagcggccctcgagggatcccctgagccgcttctcctggctccaactctgggaacncggccactctgaccatcagcgcgacccagcctctgactgaggctgactattactgtcagtacgtagggaaagtgactaagttcggggtgttcgggcggtagggaccgaaggcgtacggtaccgttcgtacggtcgacgcccaaggcctcgcccccgtcggtccacctccgtcgttcccgtcccc

SEQ ID NO: 314866 - DNA, 534 bp, Homo sapiens
  misc_feature: GZ8MTXP02GRITY.44.11.A11.1.454.CMB.2.raw
  modified_base (249)..(249): a, c, t, g, unknown or other
  misc_feature (249)..(249): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
tcagacagtatatacacgaccggtgctcgatttagctacgactgcaggggctggtcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctgggaaacttgagtgataattgcttctgtatcagcagngccaggccagcccctatgctggtcatcttcaggtataataagcgcctcgagggatcccgtgagcgcttctccgtgctcactcaggacncgccactcngaccatcagcgcacccagcctnggatggagctgactattacngtacagacgtgggaaagtgacgtagtcgggtaggttcggcggtaacgggaccaaggcgtacggaccgtttcgtacggtacgacggaccccgaaggtcccgtccgtcccccgtacggtccctacgtccgttcggttaccccctcccg

SEQ ID NO: 314867 - DNA, 517 bp, Homo sapiens
  misc_feature: GZ8MTXP02FN386.44.11.A11.1.454.CMB.2.raw
  modified_base (351)..(351): a, c, t, g, unknown or other
  misc_feature (351)..(351): n is a, c, g, or t
  modified_base (384)..(384): a, c, t, g, unknown or other
  misc_feature (384)..(384): n is a, c, g, or t
  modified_base (404)..(404): a, c, t, g, unknown or other
  misc_feature (404)..(404): n is a, c, g, or t
  modified_base (441)..(441): a, c, t, g, unknown or other
  misc_feature (441)..(441): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaacttgagtgataaatttgcttcctggtatcagcagaggccaggccagcccccctatgctggtcatctttcaggataataagcggccctcagggatcccctgagcgcttctcctggcctccaactctgggaacncggccactctgaccatcagcgcgacccagcctnggatgaggctgactattacngtcagacgtgggaaagtgcgtaagttgggtgttcggnggaggaccaagctgaccgttctcggtcacgcccaaggcctcgcccccgtcggtccaccgttctcgttccccgtccc

SEQ ID NO: 314868 - DNA, 511 bp, Homo sapiens
  misc_feature: GZ8MTXP02FWMJP.44.11.A11.1.454.CMB.2.raw
  modified_base (349)..(349): a, c, t, g, unknown or other
  misc_feature (349)..(349): n is a, c, g, or t
  modified_base (470)..(470): a, c, t, g, unknown or other
  misc_feature (470)..(470): n is a, c, g, or t
  modified_base (485)..(485): a, c, t, g, unknown or other
  misc_feature (485)..(485): n is a, c, g, or t
  modified_base (496)..(496): a, c, t, g, unknown or other
  misc_feature (496)..(496): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctggggaaacttgagtgataaatttgcttctggtatcagcagagccaggccagccccctatgctggtcatctttcaggataataagcggccctcagggatccctgacgcgcttctcctggcctcaactctagggaacncggccactctcgaccatcagcgcgacccagcctctgatgaggctgactattactgtcagacgtagggaaagtgactaagtttggggtgtttcgggcggtagggaccaaggctgaccgttcncggtcacgccagccncgcccctggcnctctcgtccctaccc

SEQ ID NO: 314869 - DNA, 571 bp, Homo sapiens
  misc_feature: GZ8MTXP02GUZI1.44.11.A11.1.454.CMB.2.raw
  modified_base (313)..(313): a, c, t, g, unknown or other
  misc_feature (313)..(313): n is a, c, g, or t
  modified_base (351)..(351): a, c, t, g, unknown or other
  misc_feature (351)..(351): n is a, c, g, or t
  modified_base (471)..(471): a, c, t, g, unknown or other
  misc_feature (471)..(471): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctgggaaaacttgagtgataaattgcttctggtatcagcagagccaggccacgcccctatcgctggtcattcttcaggataatagcgcctcgagggactcccngacgcgcttctcctcgcctaccaactcgtacggaaccnccggccacgtcctcgaccactcacgccgccgacccagcctgtcgatcgacggctagacttaattactgtacacggtacgtagggtaaagtgtaacgttaaagttggggtggttaccgggnggacgggaccgaagtcgttcggaccgttcgtcggacgaccgacccgtaacggccttccggccccctcggtaccctaccgttccgttccgtccccgtcccc

SEQ ID NO: 314870 - DNA, 639 bp, Homo sapiens
  misc_feature: GZ8MTXP02IE12W.44.11.A11.1.454.CMB.2.raw
  modified_base (230)..(230): a, c, t, g, unknown or other
  misc_feature (230)..(230): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctctgggaaacttgagtgatntttaaaaaaaaaaagtcttcctggtatctagcagaggccaggccacgccccctatgctggtcatcttcaggataataagcggcctcgaggactcctgacgcgcttctcctgctccactcgtacggaacgcggccgactctcgaccatcacgccgcgacccagccctgtaggactggaacggtctaggtaccttagttaactgtaccgaggtaccggtaggggtaaaagtcggtacttaaggttggggttcgtttacgggggacggtaacggggacctaaacggtcgtacggtacccggttcgttaccgggtaccgaccggtaccccgaagggtacccgtccggtacccccccggttccgggttaccctaacccgtttcccggttaccccgtttacccccggttcccccg

SEQ ID NO: 314871 - DNA, 561 bp, Homo sapiens
  misc_feature: GZ8MTXP02F9CPC.44.11.A11.1.454.CMB.2.raw
  modified_base (365)..(365): a, c, t, g, unknown or other
  misc_feature (365)..(365): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacgaggggtccggggcctcctctgacctgactcagccatcctcactgtccgtcgtccccaggacacacagtcactattacctgctcgtaggggaaaacttgagtgaattaattgcttctggtatcagcagaggccaggccacgccccctatcgctggtcattcttcaggataatacgcgcctgagggactcccgtgacgcgtcttctccgtcggcctaccaactcgtacgggaacnccggcctactctacgacctatccacgccgccgacccacgccctgtaggactggaggctagacttatactgtcgagtacggtaggaagtgtacgtagttgggtgtcggaggacggacagtcgtacgacgttcgcggtcacggccgaacggcctaaccggtccccgtcggtcctaccgtcgtcccgtacccctacccg

SEQ ID NO: 314872 - DNA, 730 bp, Homo sapiens
  misc_feature: GZ8MTXP02JXMLQ.44.11.A11.1.454.CMB.2.raw
  modified_base (253)..(253): a, c, t, g, unknown or other
  misc_feature (253)..(253): n is a, c, g, or t
  modified_base (317)..(317): a, c, t, g, unknown or other
  misc_feature (317)..(317): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctcgtagggaaacttgagtgataatttgcttctggtatcagcagngcagccacgcccctatcgctggtcattcttcagtataataacgcggcctcgagggtactcccgngacgtccgtcgttctccgtcggccttaccaaccgttcgtacggggaaacctccggggacccaacgttccgtacgaccctagtccacggccgacccgaaccccacggtccctacgtggtaactcgggaacgtccgttaggtaccttaacgtttaacccgtggttaaccgtaacgggtaaccggggttaaggggtaaaacgggttcgtaaacccggttttaaaggtttacggggggtttcggttaccgggggtaccggggaaacgggggtacccgtaaaacggggtccttaaccgggtaccccggtttccggtaccgggttaccgaccggaccccgaacgggggtccccttcccggaccccccgttccgggttacctacccggtttcccgtttcccgggtcccccgtttcccccg

SEQ ID NO: 314873 - DNA, 651 bp, Homo sapiens
  misc_feature: GZ8MTXP02HQ7QV.44.11.A11.1.454.CMB.2.raw
  modified_base (248)..(248): a, c, t, g, unknown or other
  misc_feature (248)..(248): n is a, c, g, or t
  modified_base (408)..(408): a, c, t, g, unknown or other
  misc_feature (408)..(408): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacgagggtccgggcctcctctgacctgactcagccatcctcactgtccgtgtccccaggacacacagtcactattacctgctcgtagggaaacttgagtgattaattgcttctgtactnagcagagccaggccacgcccctatgctggtcatcttcagataatagcgcctacgagggactccgtgacgcgtcttctccgtcggcctaccaaccgttcgtacgggaactccgggacctacctcgtacgacctagccacgccgaccgacccacgccctcgngactggagtctcggacttacgttacgttacgtaccgaaggtaccgttaggggaaagttcgtaacgttaaaggtttcgggggttagggtttccggggacgggttaacggggtaacccgaaacgggtccggttaccggtacccggtttacggtccgggtacgtaccggaccccggaacggtaccgtccccggtcccccgttacggtccctaacggttccccttaccgttccccctttaacccccg

SEQ ID NO: 314874 - DNA, 517 bp, Homo sapiens
  misc_feature: GZ8MTXP02JF9WX.44.11.A11.1.454.CMB.2.raw
  modified_base (342)..(342): a, c, t, g, unknown or other
  misc_feature (342)..(342): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctgggaaacttgagtgataattgcttctggtatcagcagaggccaggccagccccctatgctggtcatcttcaggataatagcgcctcgagggactccctgagcgcttctcctggctccactctcgggaacncggccacgtctgaccatcagcgccgacccagcctctgatgaggctgactatactgtcagacgtgggaagtgactaagttgggtgttcggcggaggtaccaagtcgtgaccgttcgtacggtcacgcccgaaggtcctccgcccccgtcggtcctaccgtccttcgtccccgtccc

SEQ ID NO: 314875 - DNA, 522 bp, Homo sapiens
  misc_feature: GZ8MTXP02GYDHG.44.11.A11.1.454.CMB.2.raw
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
  modified_base (439)..(439): a, c, t, g, unknown or other
  misc_feature (439)..(439): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctgggaaacttgagtgataattgcttctgtatcagcagaggccaggccagccccctatcgctggtcatctttcaggataataagcggcctcgagggactccctgacgccgcttctcctggctccaactctagggaacnccggccactctcgaccatcgacncgcgacccagcctcgngactgagctgactatacngtcagacgtggaagtgactaagtgggtgttcggnggaggaccaaggctaggtaccgtcgttcggacacgcccgaaggcctcgcccccgtcggtccacgttcgtcgttccccgtcccc

SEQ ID NO: 314876 - DNA, 557 bp, Homo sapiens
  misc_feature: GZ8MTXP02H6QA3.44.11.A11.1.454.CMB.2.raw
  modified_base (366)..(366): a, c, t, g, unknown or other
  misc_feature (366)..(366): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattacctgctctgggaaaacttgagtgataaattgcttcctggtatcagcagagccaggccagccccctatgctggtcatctttcagataatagcgcctcagggatccctgagcgcttctcctgctccaactcgtgggaacacggccaactctcgacccatcagcnccgacccagcctctgatgaggctagactattactgtcagtacgtagggaaagtgactaagttggggtagttcgggcggaagggacccgaaaggtctacgggtacccgttcgtccggttcgacgaccccgtaaagggcccttaaccgccccctaccgggtcctaccgtcctcggtttaccccctaacccccg

SEQ ID NO: 314877 - DNA, 624 bp, Homo sapiens
  misc_feature: GZ8MTXP02FG143.44.11.A11.1.454.CMB.2.raw
  modified_base (212)..(212): a, c, t, g, unknown or other
  misc_feature (212)..(212): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctntggggaaaacttgagtgataaatttgcttctggtatcagcagagccaggccagccccctatgctggtcatctttcaggataataagcggccctnacgggntcccgtgagcgtctttcnctggccncaactcgtacggaacncggccactctcgaccatcagcncgacccagcctcgtggatgaggcgtgactacttactcgtacgaggacgtagggtaaaggtaggtacgttaagtttacggggttgggtttcgggacgggggtacgggggaaccggaaacggtacggtacggttaaccggttaccggttaccggttccggtacggtacccggaaccggtaccggttcccggcccccggttacccgggtcccggtaacccgttaccttcccggtttccccgttaaccccccg

SEQ ID NO: 314878 - DNA, 684 bp, Homo sapiens
  misc_feature: GZ8MTXP02JBEAS.44.11.A11.1.454.CMB.2.raw
tcagacagtatatacacgaccggtgctcgatttagctacgactgcaggggctgggcctcaggaagcagcatcggaggtgcctcagccatggcatggatccctctcttcctcggcgtccttgcttactgcacagggtccgggcctcctctgacctgactcagccatcctcactgtccgtcgtccccaggacacacagtcactatacctgctcgtagggaaacttgagtagattaattgcttcgtggtatcagcagaggccaggccacgccccctatcgctggtcagtttcttcgaaggtataaagtaacgccggtacccgtacgaaggggtacctcccgtaggacgtccgtctttcctccgtggtacctaccgtaactcgtagggaacctccggacctaacgtcgtacgacctataccgacggccgacccgacccgtacgtaccgtcgtacggagtacggaacggtcttaacgacttacgtttacgtcgttaccggaacggtacggtaacgggtaaaaggttcggtaacgttaaggtttcgggggttacggttaccggggacggggacgggtaaccgtaacggtcgtaccggtaccgtaccgggtaacggtacgaccggaacccgtacggcctaacccggtccccgtcggtacctaccttcccgttccggttaccccctaacccg

SEQ ID NO: 314879 - DNA, 612 bp, Homo sapiens
  misc_feature: GZ8MTXP02J0Q7C.44.11.A11.1.454.CMB.2.raw
  modified_base (207)..(207): a, c, t, g, unknown or other
  misc_feature (207)..(207): n is a, c, g, or t
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccgggcctcctctgacctgactcagccatcctcactgtccgtgtccccaggacacacagtcactattaccngctcgtaggggaaacttgagtgataattgcttcctggtatcagcagacggccaggccacgccccctatcgctggtcattcttacgagataanaacggccggccctcgacgggtctccccgtggacgccgtcttctccgtggcctaccaactcgtacgggaaccncgggccactcagaccatcacgccgaccgacccacgcctcnggngtcgagctgtactattactgtacgaggacggtagggaagttgacgttaaggtttggggtacggttcggggacggggtacggaaccgtaaggtccgttacggtacccggttccggtacggtccgaaccggccccgtaacggtcccgtcccggcccccgttcggtacctaccgttccttacccggtccccttaacccccg

SEQ ID NO: 314880 - DNA, 509 bp, Homo sapiens
  misc_feature: GZ8MTXP02G3C3C.44.11.A11.1.454.CMB.2.raw
  modified_base (271)..(271): a, c, t, g, unknown or other
  misc_feature (271)..(271): n is a, c, g, or t
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
tcagacagtatatacacgaccggtgctcgatttagctacgactgcaggggctgggcctcaggaagcagcatcggaggtgcctcagccatggcatggatccctctcttcctcggcgtccttgcttactgcacagggtccggggcctcctctgacctgactcagccatcctcactgtccgtgtccccaggacacacagtcactattacctgctcgtagggaaaacttgagtgataaatttgcttctggtatcagcagagcagccagcccctangctgcatcttcagataataagcggcctgagggatccgtgagcgcttctctgctcaactcgtagggaacnccgggccaactcagaccancagcgcgaccngtcctgngatgngntatatattatgtagagagtaggaagtagtagtagtaggtgtacggaggaggacgaacgacgtcgtacgtcgtcgacgacgaccgacgacgccgtcccgtccgtctacgtccgtccgtcccgtccc

SEQ ID NO: 314881 - DNA, 535 bp, Homo sapiens
  misc_feature: GZ8MTXP02FOHDT.44.11.A11.1.454.CMB.2.raw
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
tcagacagtatatacacgaccggtgctcgatttagctacgactgcaggggctgggcctcaggaagcagcatcggaggtgcctcagccatggcatggatccctctctttctcggcgtccttgcttactgcacagggtccggggcctcctctgacctgactcagccatcctcactgtccgtgtccccaggacacacagtcactattacctgctctgggaaactgagtgataatttgcttcctggtatcagcagaggccaggccagccccctatgctggtcatctttcaggataataagcggccctcgagggactcccgtgagcgcttcnctggcctcaactcgtaggaacnccggccactctcgaccatcagccgcgacccagcctgtgatgaggctgactattactgtacaggacgtagggaaagtgacgttaagttggggtgttcgggaggtacggggaccaaggcgtcggaccgttcgtcggtacacgcccgaaggcctcgccccctcggtccacgtcctccgtccccgtcccc

SEQ ID NO: 314882 - DNA, 534 bp, Homo sapiens
  misc_feature: GZ8MTXP01A0Z4B.9.78.H01.1.454.CMB.2.raw
  modified_base (437)..(437): a, c, t, g, unknown or other
  misc_feature (437)..(437): n is a, c, g, or t
  modified_base (465)..(465): a, c, t, g, unknown or other
  misc_feature (465)..(465): n is a, c, g, or t
tcagtgatacgtctcacgaccggtgctcgatttagtgtgagtagtttgggtttgggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttgccctggttatacctgacaacttggggccagggaaccctggtcaccgtctcctcagcctccaccaagggcccatccggtcttcccctggccnccctgctccaggggacgcacctccgagngcacacgcggtccctgggctgcctgggttcaaggctactccagcgttatcactgagcgggctggcaagg

SEQ ID NO: 314883 - DNA, 630 bp, Homo sapiens
  misc_feature: GZ8MTXP01CVYRA.9.78.H01.1.454.CMB.2.raw
  modified_base (363)..(363): a, c, t, g, unknown or other
  misc_feature (363)..(363): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagtgggtttcatacatttatcctagtggtgataccatatactacgcagactctgtgaagggccgattcaccatctccaagggacaaacgccaaagaactcactgactttgacaaaatcgaacaccctgcgagccgaggacacggcccgtatattacngtgacgagaactaacccgttgcctgtattaccttgacacttggggccagggaaccctggtcaccgtctcctcacgccctccaaccgaaacgggccccaattcccgggtcctttccccccgtggcccgccccttggaccctcccgaacgggacgcccttacccgtcccggaagacggccaacgacgggcccgggttccccgttgggggcccttcggaccccgttgggttaccgaaaacggggttacccttaaccgtttccccaaaggg

SEQ ID NO: 314884 - DNA, 572 bp, Homo sapiens
  misc_feature: GZ8MTXP01BV9JV.9.78.H01.1.454.CMB.2.raw
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaaggccattcaccatctccagggacaacgccaaagaactcactgactttgacaaatgaacaccctgcgagccgaggacacggcccgtatatactgtgacgagaactaacccgttcgccttggttacttaccttgacacgttggggccagggaccctggtcaccgtctcctcacgcctccaaccgaacgggccccaacgtccgggtccttcccccgtggcccgccctgctccaggacnccaccncgagcgcacgacggccggcccgttcgggcctcgccgtcggtacgaacggttacctaaccgttccgaag

SEQ ID NO: 314885 - DNA, 566 bp, Homo sapiens
  misc_feature: GZ8MTXP01A1JGA.9.78.H01.1.454.CMB.2.raw
  modified_base (281)..(281): a, c, t, g, unknown or other
  misc_feature (281)..(281): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgaggggaaggggctggagtgggtttcatacatttatcctagtggtgataccatatactacgcagactctgtgaagggccattcaccatcnccagggacaacgccaagactcactgactttgacaaatgaaccaccctgcgagccgaggacacggccctatatacngtgacgagaactacccgtcnctggtattactgacncgttgggccagggacctggtcaccgtctcctcacgccctaccaccgaacgggcccctagtccggtccttccctccgtcggccgtcccgtgcctccgaggcgccaaccctcgagacgcgaacgcggccggcccttggggcctcggccgttcgggtcgaacgggtccttcgtaaccg

SEQ ID NO: 314886 - DNA, 571 bp, Homo sapiens
  misc_feature: GZ8MTXP01AGPCB.9.78.H01.1.454.CMB.2.raw
  modified_base (352)..(352): a, c, t, g, unknown or other
  misc_feature (352)..(352): n is a, c, g, or t
tcagtgatacgtctcacgaccggtgctcgatttagtgtgagtagtttgggtttgggtgccgaagttgcttgaggtcacggtcaccacgctgctgagggagtagggtccctgagactctcctgtgcagcctctggattcgcctctggattgacgttcagtgactactacatgacctgggtccgccaggctccgagggaaggggctggagtgggtttcatacatttatctagtggtgataccatatactacgcagactctgtgaagggccattcacatctcagggacaacgccaagaactcactgactttgcaaatgaacaccctgcgagccgaggacacggccctatattacngtgacgagaactaacccgttcgcctggttacttaccttgaacctacgttgggccagggaccctggtccaccgtctcctcacgccctaccaccgaacgggccccaagtccggtcccttcccccgtggcccgcccgtgcctccgaggacgccacccgtcgacgagccacgacgccggcccgttggggcctggcctggtcaacgggcctaacgttcccgaag

SEQ ID NO: 314887 - DNA, 614 bp, Homo sapiens
  misc_feature: GZ8MTXP01CHQ8N.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccaggggaaggggctggagtgggttttatacatttatcctagtggtgataccatatactacgcagactctgtgaagggccattcacatctccagggacaacgccaaagaactcactgactttgacaaatgaacaccctgcgagccgaggacacggccgtaatattactgtgacgaaagaaacttaacccgttcgccttagggttaactttacccttgactacgttggggacctaaggggaaccctggtccaccggtcctccctcacgcctccaaccaacgggccccaggtccggtccttcccccgtggcccgccccgtcgcctaccgaggacgccacccgtccgaacgacgccacgacggccggcccgttcggggccttcggcccgtgggtccgaaacgggtaccttacgttcccgaagtaaccg

SEQ ID NO: 314888 - DNA, 565 bp, Homo sapiens
  misc_feature: GZ8MTXP01BO1IM.9.78.H01.1.454.CMB.2.raw
  modified_base (504)..(504): a, c, t, g, unknown or other
  misc_feature (504)..(504): n is a, c, g, or t
  modified_base (529)..(529): a, c, t, g, unknown or other
  misc_feature (529)..(529): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacatttatcctagtgtgataccatatactacgcagactctgtgaagggccattcaccatctccagggacaacgccaagactccatgactttgcaaatgaacaccctgcgagccgaggacacggcccgtatatactgtgacgaagaataacccgtcgccctggttacttaccttgacacgttggggccagggaaccctggtcaccgtctcctcacgccctaccaaccgaaacgggccccaagtccgggtccttcccccgtggcccgcccctgacctcccgagggaccnccaccgcgagcgcacgcgccgccgnggctcgccgtggacaacgttacctaacgttccgaag

SEQ ID NO: 314889 - DNA, 790 bp, Homo sapiens
  misc_feature: GZ8MTXP01CKKGU.9.78.H01.1.454.CMB.2.raw
  modified_base (235)..(235): a, c, t, g, unknown or other
  misc_feature (235)..(235): n is a, c, g, or t
  modified_base (278)..(278): a, c, t, g, unknown or other
  misc_feature (278)..(278): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagtgggtttcatacatttatctagtggtnataccatatactacgcagactctgtgaagggccattcacatcnccaggacaacgccaagactcactgactttgacaaatgaacaccctgcgagccgaggacacggccctatattactgtgaacgaagtaactaaccccgttcgacccgtttaggttaacttacccgttgaaacccgtacgtttacgggggacccgtaaacggggtaaccccgttcgggtacccgaaccccggtttcccgttccccttacccgaaccggtcccccttacccccgaaaccccggtaaacccgggggaccccctaaaccggtttccccgggggtttaccccctttacccccccccggttcggggtcccccggtcccccgttcggtaccccgttaccccgtaaccggggaccgacccctaacccccggttaaccccgggaaaggaccgggacccaaccggtaaacccgggtccccggggcccccgttcgggggccccgttcgggacccccgttcggggttaacccgaaaacggggttacccttaaccccgtttaacccggtaaaccggg

SEQ ID NO: 314890 - DNA, 585 bp, Homo sapiens
  misc_feature: GZ8MTXP01BHWAF.9.78.H01.1.454.CMB.2.raw
  modified_base (476)..(476): a, c, t, g, unknown or other
  misc_feature (476)..(476): n is a, c, g, or t
  modified_base (496)..(496): a, c, t, g, unknown or other
  misc_feature (496)..(496): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctgtgaagggccattcaccatctccagggacaacgccaagaactcactgactttgacaaaatgaacaccctgcgagccgaggacacggccccgtatattactgtgacgaagaactaacccgttcgcccttggtttacttaccttgacacgttggggccagggaaccctggtcaccgtctcctcacgcctccaccaacgggcccatccggtccttccccgngccgccctgcctccaggacnccaccaaccgagacgccacgacggcccggccccgttggggccttcggcccgtaacgggtaccaacgggttacctaacctttccgaaacg

SEQ ID NO: 314891 - DNA, 638 bp, Homo sapiens
  misc_feature: GZ8MTXP01EGTBL.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgaggggaaggggctggagtgggtttcatacatttatcctagtggtgataccatatactacgcagactctgtgaagggccattcaccatctccagggacaacgccaaagaactcactgactttgacaaatgaaacaccctgacgagccgaggacacggcccgtatattactgtgacgaagaactaacccgttcgccttggtttaacttacctgacctacgttggggccaacggggaaccctggtcctacccgtctcctcacgccctaccaaccgaaacgggcccctagtcccgggtttccttcccgtccgtcgggcccgtccccttggaccctccgaacgcggccctaacccgtccgggaaacgacgaccgaaccgtcgggcccgggttcccgttcggggcctacggtcccgtacgggtaccgaaacggttaaccttaaccgtaaccg

SEQ ID NO: 314892 - DNA, 568 bp, Homo sapiens
  misc_feature: GZ8MTXP01D82L6.9.78.H01.1.454.CMB.2.raw
  modified_base (255)..(255): a, c, t, g, unknown or other
  misc_feature (255)..(255): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgacaggctccagggaagggctggagtgggtttcatacatttatctagtgtgataccatatactacgcagactcngtgaaggccgattcaccatctccaggacaacgcaaagactcactgactttgacaaatgaacaccctgcgagcgagacacggccctatatactgtgacgaagaactaaacccgttcgccttggttaacttacctgactacgttcgggccgacgggaaccctggctaccgtctcctcacgcctccaccgaaacgggcccacgtccggttcccttcccccgtggcccgccctcgcctcccgaggcgccnccncccgagcgccacgacggccggcccgttgggcctcgccgtcggtacaacggactaacttccgaag

SEQ ID NO: 314893 - DNA, 592 bp, Homo sapiens
  misc_feature: GZ8MTXP01EQL1P.9.78.H01.1.454.CMB.2.raw
  modified_base (230)..(230): a, c, t, g, unknown or other
  misc_feature (230)..(230): n is a, c, g, or t
  modified_base (275)..(275): a, c, t, g, unknown or other
  misc_feature (275)..(275): n is a, c, g, or t
  modified_base (319)..(319): a, c, t, g, unknown or other
  misc_feature (319)..(319): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (454)..(454): a, c, t, g, unknown or other
  misc_feature (454)..(454): n is a, c, g, or t
  modified_base (560)..(560): a, c, t, g, unknown or other
  misc_feature (560)..(560): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgcaggctccgagggagggctggagtggtttcatacatttatctagtgtnataccatatactacgcagactctgtagaagggccattcaccatcncgaggacaacgccaaagactcactgactttgacaaatcgaaacnccctgacgagccgagacacggccctatatacngtagacgaanaacttaaccccgtcgccttaggtttaactttaccctgaacctacgttcggggacccgtaacgggaaccctcggtaccctacccgttccttccnccacgcccctaccaaccgaacgggccctagttcccggttcccttcccccgtgcccgccctcgcctccgaggacgccacctcgagcgcacgcgtccgcccgttcggngtcgcgtcggacacgttactaaccgttcgaag

SEQ ID NO: 314894 - DNA, 564 bp, Homo sapiens
  misc_feature: GZ8MTXP01D7AUS.9.78.H01.1.454.CMB.2.raw
  modified_base (237)..(237): a, c, t, g, unknown or other
  misc_feature (237)..(237): n is a, c, g, or t
  modified_base (324)..(324): a, c, t, g, unknown or other
  misc_feature (324)..(324): n is a, c, g, or t
  modified_base (365)..(365): a, c, t, g, unknown or other
  misc_feature (365)..(365): n is a, c, g, or t
  modified_base (430)..(430): a, c, t, g, unknown or other
  misc_feature (430)..(430): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgaggggaaggggctgggagtgggtttcatacatttatctagtggtnataccatatactacgcagactctgtgaaggccatcacatctccaggacaacgccaaagaactcactgactttgacaaatcgaaaccnccctgcgagccgaggacacggccctatatactgtgacgaanaactacccgttcgccttggttataccttgactacgttgggccagggacctggtcaccgtctctcncgcctccaccgaacggcccatccggtcctccccgtggccgccctgcctccgaggacgccacccgtcgacgacgcacgacggccggcccgttgggcctcgcccgtgggtaccaacggaccttaaccttccgaacg

SEQ ID NO: 314895 - DNA, 560 bp, Homo sapiens
  misc_feature: GZ8MTXP01BE756.9.78.H01.1.454.CMB.2.raw
  modified_base (453)..(453): a, c, t, g, unknown or other
  misc_feature (453)..(453): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctcccagggacaacgccaaagaactcactgactttgcaaatgaacacctgcgagccgaggacacggccgtatattactgtgcgaagaactaacccgttcgcccttggttattacctgacaacgttcggggccaggggaaccctggtccaccgtctcctcacgcctccaccaacgggcccagtccgtccttcccctcggccnccctgcctccgaggggacgccacctccgagacgcacgacgccggcccgtgggctgcctggttcaaggactactcagcgttactcacgtgaggcgggctggcgaaggg

SEQ ID NO: 314896 - DNA, 583 bp, Homo sapiens
  misc_feature: GZ8MTXP01EI6N2.9.78.H01.1.454.CMB.2.raw
  modified_base (182)..(182): a, c, t, g, unknown or other
  misc_feature (182)..(182): n is a, c, g, or t
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccncaggctccgaggggaagggctggagtggtttcatacatttatctagtggtnataccatatactacgcagactntgtgaaggccatcacatcncaggacaacgccaaagactcactgactttgacaaatgaaccaccctgcgagccgagacacggccctatattacngtgacgaanaactacccgttcgccttaggtttacttaccgttgactacgttcggggaccacgggaaccctggtccaccgttctcctcacgccctaccaaccgaacgggccctacgtccggttcccttcccccgtggcccgtcccgtgcctccgaggacgccaccctccgagcgcacgacggcccggcccgttgggcctcgccgtcggtacgaaggttacctaaccgttccgaacg

SEQ ID NO: 314897 - DNA, 595 bp, Homo sapiens
  misc_feature: GZ8MTXP01D5WZS.9.78.H01.1.454.CMB.2.raw
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
  modified_base (292)..(292): a, c, t, g, unknown or other
  misc_feature (292)..(292): n is a, c, g, or t
  modified_base (348)..(348): a, c, t, g, unknown or other
  misc_feature (348)..(348): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgaggggaagggctggagtggtttcatacatttatctagtgtnatacatatactacgcagactntgtgaaggccattcacatctcaggacaacgccaagacncactgactttgacaaatgaacaccctgcgagccgaggacacggcccgtatattacngtcgacgaagtaacgtaaccccgttcgcccttagggtttaacttacccttgaacctacgttcgggggaccgaacggggaacccgttggtccacccgttcctcctcacgccctaccaccgaacgggcccacgttccggtccttcccccgtcggcccgccctcgcctccgacggacgccacctccgagacgcacgacgccgggcccgttcgggctcggcccgtggtccgaacggactaaccttcgaacg

SEQ ID NO: 314898 - DNA, 575 bp, Homo sapiens
  misc_feature: GZ8MTXP01A85Y3.9.78.H01.1.454.CMB.2.raw
  modified_base (279)..(279): a, c, t, g, unknown or other
  misc_feature (279)..(279): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaaggggctggagtgggtttcatacatttatcctagtggtgataccatatactacgcagactctgtgaagggccatcaccatcncagggacaacgccaaagactcactgactttgacaaatgaacaccctgcgagccgaggacacggcccgtatatactgtgacgaagaactacccgtcgccttaggttacttacctgactacgttgggaccagggaaccctggtcaccgtctcctcacgccctccaaccaacgggcccacgttccggtccttcccccgtgcccgcccctgccctccacggacgccacccgtcccggagacgcacgcggccggcccgttgggcctcggacccgtggtcaaggttacctaacgttccgaag

SEQ ID NO: 314899 - DNA, 567 bp, Homo sapiens
  misc_feature: GZ8MTXP01AMO1D.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctgtgaagggccgattcaccatctccagggacaaacgccaagaactcactgactttgacaaatgaacaccctgcgagccgaggacacggcccgtatattactgtgacgagaactaacccgtcgcctggttattacctgacacgttgggccagggaaccctggtcaccgtctcctcacgcctccaccgaacgggccccatccggtccttcccccgtggccgcccgtcgcctccaggacgccaccgtccgggagcacgacgccggcccttcgggcttcgcctggtcgaacggccttacgttccgaagtaaccg

SEQ ID NO: 314900 - DNA, 564 bp, Homo sapiens
  misc_feature: GZ8MTXP01BU9US.9.78.H01.1.454.CMB.2.raw
  modified_base (182)..(182): a, c, t, g, unknown or other
  misc_feature (182)..(182): n is a, c, g, or t
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (473)..(473): a, c, t, g, unknown or other
  misc_feature (473)..(473): n is a, c, g, or t
  modified_base (500)..(500): a, c, t, g, unknown or other
  misc_feature (500)..(500): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccnccaggctccgaggggaagggctggagtggtttcatacatttanctagtgtnataccatatactacgcagactctgtggaacgggccattcaccatctccgaggacaacgccaaagactcactgtactttgacaaaatcgaaccnccctgcgagccgagacacggccctatatacngtgaacgaanaactaacccgtgccttggttaacttaccgtgacctacgttcggggcacgggaccctggtccaccgtctcctcacgcctccacgacggccagtccggtcctccccgngccgccctgacctcgaggcgcctaccncgacgagccacgacgtccggccgttgggctcggcccgtggtcaacggacctaacgttcccgaag

SEQ ID NO: 314901 - DNA, 597 bp, Homo sapiens
  misc_feature: GZ8MTXP01AH4J3.9.78.H01.1.454.CMB.2.raw
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctgtgaaggccattcaccatctccagggacaacgccaagaactcactgactttgacaaatgaacaccctgcgagccgaggacacggcccctatattactgtgacgagtaactaacccgttcgccttaggttacttaccgttgactacgttcggggccgacgggaaccctggtcaccgtctcctcacgcctccaccgaacgggcccacgtccggtccttcccccgtcggcccgccccgtcgcctccgacgggacgccaccctccgacgacggccaccgacggccggcccgttcggggccttcggccgtcgggtacgaacgggaccttaacgttcccgaacgg

SEQ ID NO: 314902 - DNA, 556 bp, Homo sapiens
  misc_feature: GZ8MTXP01BALGB.9.78.H01.1.454.CMB.2.raw
tcagtgatacgtctcacgaccggtgctcgatttagtgtgagtagtttgggtttgggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccattcaccatctccagggacaacgccaagaactcactgacttgacaaatgaacacctgcgagccgagacacggcgtatattactgtgcgagaactaacccgtcgcccctggttattacctgacaacgttgggccagggaaccctggtccaccgtctcctcacgccctaccaccgaacgggcccatccggtccttccccgtggccgccctgcctccgaggggcgccaccctccgacgacgcacgacgccggcccgtggggcctcggcctggttcaacggcctactcagcgttatcactgacgcgggctggcgaaggg

SEQ ID NO: 314903 - DNA, 411 bp, Homo sapiens
  misc_feature: GZ8MTXP01AJYBU.9.78.H01.1.454.CMB.2.raw
  modified_base (253)..(253): a, c, t, g, unknown or other
  misc_feature (253)..(253): n is a, c, g, or t
  modified_base (407)..(411): a, c, t, g, unknown or other
  misc_feature (407)..(411): n is a, c, g, or t
tcagtgatacgtctcacgaccggtgctcgatttagtgtgagtagtttgggtttgggaggcttggtcaagcctggagggtccctgagactctcctgtgcagcctctggattcgcctctggattgacgttcagtgactactacatgacctgggtccgccaggctccgaggggaagggctggagtgggtttcatacatttatcctagtggtgataccatatactacgcagactctgtgaagggccattcaccatcnccgagggacaacgcaagactcactgactttgcaaacatcggtccttccccctggccacccctcctccaagacgccacctctgggggcacagcggcctggcctgctggtcaagactactcatagtgcgactgagcgggctggcaaggcgcatagnnnnn

SEQ ID NO: 314904 - DNA, 588 bp, Homo sapiens
  misc_feature: GZ8MTXP01A0GHD.9.78.H01.1.454.CMB.2.raw
  modified_base (234)..(234): a, c, t, g, unknown or other
  misc_feature (234)..(234): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccgagggaagggctggagtgggttcatacatttatcctagtggtnataccatatactacgcagactctgtgaaggccattcaccatctccaggacaacgccaaagactcactgactttgacaaatgaacaccctgcgagccgagacacggccctatattactgtgacgaagaactaacccgttcgccttggttattaccgttgacacgttgggccacgggaaccctggtcaccgtctcctcacgccctaccaccaacgggccccagtccggtcccttcccccgtcggcccgccccgtcgcctcccgaacggacgcccacccgtcccgaacgacgccacgacggccggccccgttgggcctcgccgtcgggtacaacgggttacctaaccgttccgaacg

SEQ ID NO: 314905 - DNA, 561 bp, Homo sapiens
  misc_feature: GZ8MTXP01ARCRX.9.78.H01.1.454.CMB.2.raw
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
  modified_base (493)..(493): a, c, t, g, unknown or other
  misc_feature (493)..(493): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtaactactacatgacctgggtccgccaggctccgagggaagggctggagtggtttcatacatttatctagtggtgataccatatactacgcagactctgtgaaggccattcacatctcaggacaacgcaagactcactgactttgacaaatgaacnccctgcgagccgagacacggctatattacngtgcgaaanaactaacccgttcgccttaggttacttaccttgactacgttggggaccagggaaccctggtccaccgtctcctcacgccctccaaccgacggccccagtccggttcccttccccgnggcccnccctgcctccgaggaccncaccctcgaagacgcacgcgccggccgttgggcttcggcctggtcaacggacttactccgaagtaacg

SEQ ID NO: 314906 - DNA, 600 bp, Homo sapiens
  misc_feature: GZ8MTXP01DMIFQ.9.78.H01.1.454.CMB.2.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (317)..(317): a, c, t, g, unknown or other
  misc_feature (317)..(317): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttanctagtggtnataccatatactacgcagactctgtgaaggccattcaccatctcaggacaacgccaagactcactgactttgacaaatgaacnccctgcgagccgaggacacggccctatattactgtgaacgaagtaactaacccgttcgaccttggttaacttaccgttgacctacgttcggggaccgacgggtaaccctggtcaccgtctcctcacgccctaccaccgaacgggcccacgtccggttcccttcccccgtggcccgcccgtcgcctccgaggcgccacccgtccgacgacgccacgacggcccggcccgttcggggcctcggccgtcgggtaccgaaacgggttaccttaaccgttcccgaacg

SEQ ID NO: 314907 - DNA, 629 bp, Homo sapiens
  misc_feature: GZ8MTXP01DW7XF.9.78.H01.1.454.CMB.2.raw
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaaggccgattcaccatctccagggacaacgcaagaactcactgactttgacaaatgaacaccctgcgagccgaggacacggccgtatattactgtgcgagaaactaacccgttcgcccctggttattaccttgactaacgttcgggccgagggaaccctggtccacccgtctcctcacgcctccaccgaacgggcccacgtccggtcctttcccccgtcggcccgccccgtcgcctcccgaggggacgccacccgtcccgagacgccaacgacggccggcccgtgggcctcggccgtcgggttacaaacgggttaccttaccgttcccgaacggttaccggttactccgtaaaccgtggaacggggcccggggcgtcggggaaccgaaacgggg

SEQ ID NO: 314908 - DNA, 646 bp, Homo sapiens
  misc_feature: GZ8MTXP01A0Q8H.9.78.H01.1.454.CMB.2.raw
  modified_base (291)..(291): a, c, t, g, unknown or other
  misc_feature (291)..(291): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaaggggctggagtgggtttcatacatttatcctagtggtgataccatatactacgcagactctgtgaagggccatcaccatctcaggacaacgcaagactcactgacttgacaaatgaacncctgcgagccgaggacacggctatatactgtgcgaagaactacccgttcgcccttggttacttaccgtgactaacgttcggggccaggggaccctgggtccaccgtctcctcacgccctccaacccgaacgggcccctacgttcccggttccccttcccccgtcgggccccgccccgtcgccgtacccgagggggaaccgccaacccgtcccggaacgccggccaccgacggcccggtccccgtcggggcccgttcggccccgttgggttaccgtaaacgggaccttaacccgttccgaacggttaccgttactaacgtaccggtggacgggccgggttccgtcgggccgaaggg

SEQ ID NO: 314909 - DNA, 534 bp, Homo sapiens
  misc_feature: GZ8MTXP01CV7KB.9.78.H01.1.454.CMB.2.raw
  modified_base (276)..(276): a, c, t, g, unknown or other
  misc_feature (276)..(276): n is a, c, g, or t
  modified_base (348)..(348): a, c, t, g, unknown or other
  misc_feature (348)..(348): n is a, c, g, or t
  modified_base (514)..(534): a, c, t, g, unknown or other
  misc_feature (514)..(534): n is a, c, g, or t
tcagtgatacgtctcacgaccggtgctcgatttagtgtgagtagtttgggtttgggtttcatacatttatcctagtggtgataccatatactacgcagactctgtgaagggccgattcaccatctccagggacaacgccaagaactcactgacttttgcaaatgaacaccctgcgagccgaggacacggccgtatattactgtgcgagaataacccgttcgccttggttattaccttgacacttggggccagggaaccctggtcaccgttctcccncacgccctccaaccgaacgggccccagtccggtcccttccccccgtggcccgccccgtgcctccgagggacncccaccctccggagacgccacgacggccgggccccgttgggggctacggcccgttggggtaccccgaaacgggtaccttaccttacccgaacgggtaaaccttaatcccgaaacgtggggaacgggtccgggggcctacggggaccgaaagggccgtactagaggnnnnnnnnnnnnnnnnnnnnn

SEQ ID NO: 314910 - DNA, 548 bp, Homo sapiens
  misc_feature: GZ8MTXP01CMXY1.9.78.H01.1.454.CMB.2.raw
  modified_base (325)..(325): a, c, t, g, unknown or other
  misc_feature (325)..(325): n is a, c, g, or t
  modified_base (451)..(451): a, c, t, g, unknown or other
  misc_feature (451)..(451): n is a, c, g, or t
  modified_base (468)..(468): a, c, t, g, unknown or other
  misc_feature (468)..(468): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgagggaagggctggagtgggtttcatacatttatcctagtggtgataccatatactacgcagactctgtgaaggccattcaccatctcaggacaacgccaagaactcactgacttgacaaatcgaaacaccctgcgagccgaggacacggctatattacngtgacgaagaactaacccgttcgccccttaggttacttaccttgactacgttgggccagggtaaccctgggtccaccgtctcctcacgcctccacgaacggcccagtccggtcctccccgtggccncctgcctcgaggggacnccgacctcgagcgcactacgccgcctgggcctgcctggcaagctactccagcgttatcacgtgcggcggctggcgaacgg

SEQ ID NO: 314911 - DNA, 735 bp, Homo sapiens
  misc_feature: GZ8MTXP01C1DVP.9.78.H01.1.454.CMB.2.raw
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
tcagtgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtcccgccaggctccgaggggaagggctggagtgggtttcatacatttanctagtggtnataccatatactacgcagactctgtgaagggccattcaccatcctcaggacaacgcaaagactcactgtactttgacaaatcgaacctacccgtgacgacgaccgaggaccaccgggtaccccttaatacgtttacgtggtacggaacgtaacgtaacccgttaaccccggtttcgtacccgtttagggtttaaccttaccgttaggaacccgtacggtttcgggggacccgtaacggggtaaaccccgttggtacccacccgttccgtacccgtccgaccgtcccctacccgaacccgaaaccggggtcccctaacgttccccgggttccccttccccccggtcggtccccgtccccgttcgtccctaccccggaacggtaccgcccgtaacccggtcccggaacgacgacccgaccgaaccgggtcccgggccccgttcgggttcccgtcggtcccgtaacgggtaccaacggttacccttaaccgttcgtaaccgg

SEQ ID NO: 314912 - DNA, 610 bp, Homo sapiens
  misc_feature: GZ8MTXP01A5U1C.9.78.H01.1.454.CMB.2.raw
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccattcaccatctccagggacaacgccaagactcactgactttgacaaatgaacacctgcgagccgaggacacggccgtatattactgtgcgaagtaactaacccgttcgccccttggtttattaccgttgactaacgttggggccagggaaccctggtccaccgtctcctcacgccctccaccgaacgggcccagtccggtcccttcccccgtcggccgcccctgcctcccgagggggacgccaaccgtccggagacgccacgacggccggtcccgtggggcctcggcccgttggttacgaacgggaccttaccgtttcccgaagttacgttactccacgtggacggccggggttctcgggcgaacggg
